United States Patent 12,569,549 (FLAVIVIRUS VACCINE) - sequence listing, part 22

SEQ ID NO: 9744 - RNA, 9876 nt, synthetic construct
  misc_feature 1..9876: note = derived and/or modified CDS sequence (opt1) from DENV-2__GQ398261__SS-prME
  source 1..9876: mol_type = other RNA
accgcgggcatgatcatcatgctgatccccaccgtgatggccttccacctcaccacccggaacggggagccccacatgatcgtcagccggcaggagaagggcaagagcctgctgttcaagaccgaggacggggtgaacatgtgcaccctcatggcgatggacctgggcgagctgtgcgaggacaccatcacctacaactgccccctcctgcggcagaacgagcccgaggacatcgactgctggtgcaacagcaccagcacctggatcacgtacgggacctgcaccgccaccggcgagcaccggcgggagaagcggagcgtggccctggtcccccacgtgggcatggggctcgagacgcgcaccgagacctggatgtccagcgagggcgcctggaagcacgcccagcggatcgagacctggatcctgcggcaccccgggttcacgatcatggcggccatcctggcctacaccatcggcaccacctacttccagcgggtgctcatcttcatcctgctgacggccgtcgcgccctccatgaccatgcgctgcatcgggatcagcaaccgggacttcgtggagggcgtgtccggcgggagctgggtcgacatcgtgctcgagcacggctcctgcgtgaccaccatggccaagaacaagcccacgctggacttcgagctgatcaagaccgaggccaagcagcccgccaccctccgcaagtactgcatcgaggccaagctgaccaacacgaccaccgcgagccggtgcccgacccagggggagccctccctgaacgaggagcaggacaagcgcttcgtctgcaagcacagcatggtggaccggggctggggcaacgggtgcggcctcttcgggaagggcgggatcgtgacgtgcgccatgttcacgtgcaagaagaacatggagggcaaggtcgtgcagcccgagaacctggagtacaccatcgtgatcacgccccactccggcgaggagaacgccgtcgggaacgacacgggcaagcacgggaaggagatcaagatcaccccgcagagctccatcaccgaggccgagctgaccggctacgggaccgtgacgatggagtgcagcccccgcaccggcctcgacttcaacgagatggtgctgctgcagatggagaacaaggcctggctcgtccaccggcagtggttcctggacctgcccctcccctggctgccgggcgcggacacccaggggtccaactggatccagaaggagaccctggtgacgttcaagaacccccacgccaagaagcaggacgtggtcgtgctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtcgtgaaggagatcgcggagacccagcacggcaccatcgtggtccgcgtgcagtacgagggggacggcagcccctgcaagatccccttcgagatcatggacctggagaagcggcacgtgctcggccgcctgatcacggtcaacccgatcgtgaccgagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgccaagcggatggccatcctgggcgacacggcctgggacttcgggtccctgggcggggtgttcaccagcatcggcaaggcgctccaccaggtgttcggggccatctacggcgccgccttctccggcgtcagctggaccatgaagatcctgatcggggtggtgatcacctggatcggcatgaactcccgcagcacgtccctgagcgtctccctggtgctcgtgggggtcgtgaccctgtacctgggcgtgatggtccaggcggacagcgggtgcgtggtgtcctggaagaacaaggagctcaagtgcggcagcggcatcttcgtcaccgacaacgtgcacacctggacggagcagtacaagttccagcccgagagcccctccaagctggccagcgccatccagaaggcccacgaggaggggatctgcggcatccggtccgtgacccgcctggagaacctcatgtggaagcagatcacccccgagctgaaccacatcctgagcgagaacgaggtcaagctcaccatcatgacgggggacatcaagggcatcatgcaggccgggaagcggtccctgcgcccgcagcccaccgagctgaagtacagctggaagacctggggcaaggcgaagatgctctccaccgagctgcacaaccagacgttcctgatcgacggccccgagaccgccgagtgcccgaacaccaaccgggcctggaacagcctcgaggtggaggactacgggttcggcgtgttcaccacgaacatctggctgaagctgaaggagcgccaggacgtcttctgcgactccaagctcatgagcgccgccatcaaggacaaccgggcggtgcacgccgacatggggtactggatcgagtccgccctgaacgacacctggaagatcgagaaggccagcttcatcgaggtgaagtcctgccactggcccaagagccacaccctgtggtccaacggcgtcctcgagagcgagatgatcatccccaagaacttcgccggccccgtgtcccagcacaactaccgcccggggtaccacacccagaccgcgggcccctggcacctggggaagctggagatggacttcaacttctgcgagggcacgaccgtggtcgtgaccggggactgcggcaaccggggccccgccctccgcaccacgaccgccagcgggaagctgatcaccgagtggtgctgccggagctgcaccctgcccccgctccgctaccggggcgaggacgggtgctggtacggcatggagatccgccccctgaaggagaaggaggagaacctggtgaactccctcgtcacggccgggcacggccagatcgacaacttcagcctgggcgtgctggggatggccctcttcctggaggagatgctgcggacccgcgtgggcaccaagcacgccatcctcctggtcgccgtgtccttcgtgaccctgatcacggggaacatgagcttccgggacctcggccgcgtcatggtgatggtgggggccaccatgaccgacgacatcggcatgggcgtcacctacctggccctgctcgcggccttcaaggtgcgccccacgttcgccgccgggctgctgctccggaagctgacctccaaggagctgatgatgaccaccatcggcatcgtgctcctgagccagtccacgatccccgagaccatcctggagctcaccgacgccctggcgctggggatgatggtcctcaagatcgtgcgcaacatggagaagtaccagctggccgtcaccatcatggccatcctgtgcgtgccgaacgccgtgatcctccagaacgcctggaaggtcagctgcacgatcctggcggtggtgtccgtcagccccctgctcctgacctccagccagcagaaggccgactggatccccctggccctcaccatcaagggcctgaaccccaccgccatcttcctgacgaccctctcccggaccagcaagaagcgctcctggccgctgaacgaggcgatcatggccgtgggcatggtgagcatcctggcctccagcctcctgaagaacgacatccccatgaccgggcccctggtcgccggcgggctcctgacggtgtgctacgtgctgaccggccggtccgccgacctcgagctggagcgcgcggccgacgtccggtgggaggaccaggccgagatcagcgggagctcccccatcctgagcatcaccatctccgaggacggcagcatgtccatcaagaacgaggaggaggagcagaccctcacgatcctgatccgcaccggcctgctcgtgatcagcgggctgttcccggtgtccatccccatcaccgccgccgcgtggtacctgtgggaggtcaagaagcagcgggccggcgtgctctgggacgtgcccagcccgccgcccgtcgggaaggccgagctggaggacggcgcctaccgcatcaagcagaaggggatcctgggctactcccagatcggcgccggggtgtacaaggagggcaccttccacaccatgtggcacgtgacgcgcggggcggtcctcatgcacaagggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcctgttcaagaccaacaccgggacgatcggcgccgtgagcctcgacttctcccccggcaccagcgggtcccccatcgtcgacaagaagggcaaggtggtggggctgtacggcaacggcgtcgtgacccgcagcgggacctacgtgtccgcgatcgcccagacggagaagtccatcgaggacaaccccgagatcgaggacgacatcttccggaagaagcgcctgaccatcatggacctgcaccccggcgccgggaagaccaagcggtacctccccgccatcgtccgcgaggcgatcaagcggggcctgcgcaccctgatcctcgccccgacgcgggtggtggccgccgagatggaggaggccctgcgcgggctgcccatccgctaccagacccccgcgatccgggccgagcacaccggccgcgagatcgtcgacctcatgtgccacgccaccttcacgatgcggctgctgtcccccgtgcgcgtgccgaactacaacctcatcatcatggacgaggcccacttcaccgaccccgccagcatcgcggcccggggctacatcagcacccgcgtcgagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgaccgacttcaaggggaagaccgtgtggttcgtcccgtccatcaaggccggcaacgacatcgccgcctgcctgcgcaagaacggcaagaaggtgatccagctgagccggaagaccttcgactccgagtacatcaagacgcgcaccaacgactgggacttcgtggtcaccaccgacatcagcgagatgggggcgaacttcaaggccgagcgggtgatcgacccccgccggtgcatgaagcccgtgatcctcacggacggcgaggagcgcgtcatcctggccgggcccatgccggtgacccactccagcgccgcccagcggcgcggccggatcgggcgcaaccccaagaacgagaacgaccagtacatctacatgggcgagcccctggagaacgacgaggactgcgcgcactggaaggaggccaagatgctcctggacaacatcaacacccccgagggcatcatcccgtccatgttcgagcccgagcgcgagaaggtggacgccatcgacggggagtaccggctgcgcggcgaggcccggaagaccttcgtcgacctcatgcgccgcggggacctgcccgtgtggctggcctaccgcgtcgcggccgagggcatcaactacgccgaccggcgctggtgcttcgacgggatcaagaacaaccagatcctcgaggagaacgtggaggtggagatctggacgaaggagggcgagcggaagaagctgaagccgcgctggctggacgcccggatctacagcgaccccctcgccctgaaggagttcaaggagttcgcggccggccgcaagtccctgaccctcaacctgatcaccgagatcgggcggctgcccaccttcatgacgcagaaggcccgcaacgccctcgacaacctggcggtcctgcacaccgccgaggccggcgggcgggcctacaaccacgccctcagcgagctgcccgagaccctggagaccctcctgctgctcacgctgctggcgaccgtgaccggcggcatcttcctcttcctgatgtccgggaagggcatcgggaagatgaccctgggcatgtgctgcatcatcaccgccagcatcctcctgtggtacgcccagatccagccgcactggatcgccgcctccatcatcctggagttcttcctcatcgtgctgctgatccccgagcccgagaagcagcgcacgccccaggacaaccagctcacctacgtcgtgatcgcgatcctgaccgtggtcgccgccaccatggccaacgagatggggttcctggagaagacgaagaaggacttcggcctcggcagcatcgccacccagcagccggagtccaacatcctggacatcgacctgcggcccgcgagcgcctggaccctctacgccgtggccaccacgttcatcacccccatgctgcgccacagcatcgagaactccagcgtgaacgtctccctgaccgccatcgcgaaccaggccaccgtgctcatggggctgggcaaggggtggcccctgagcaagatggacatcggcgtgccgctcctggccatcgggtgctactcccaggtcaaccccatcacgctgaccgccgcgctcctgctgctcgtggcccactacgccatcatcggccccggcctgcaggccaaggccacccgggaggcgcagaagcgcgccgccgccgggatcatgaagaaccccaccgtggacggcatcacggtcatcgacctggacccgatcccctacgaccccaagttcgagaagcagctcggccaggtgatgctgctggtgctctgcgtcacccaggtgctgatgatgcggaccacctgggccctgtgcgaggcgctcacgctggccaccggccccatcagcaccctgtgggaggggaacccgggccgcttctggaacaccacgatcgccgtgtccatggccaacatcttccgcggcagctacctcgccggggcgggcctgctgttctccatcatgaagaacaccgccaacacccggcgcgggaccggcaacacgggcgagaccctcggggagaagtggaagaaccggctgaacgccctgggcaagagcgagttccagatctacaagaagtccgggatccaggaggtcgaccgcaccctcgccaaggagggcatcaagcgcggggagaccgaccaccacgcggtgagccgcggctccgccaagctgcggtggttcgtggagcgcaacctggtcacgcccgagggcaaggtggtggacctcgggtgcggccgcggcgggtggagctactactgcggcgggctgaagaacgtccgcgaggtgaaggggctgaccaagggcgggcccgggcacgaggagcccatcccgatgtccacctacggctggaacctcgtgcggctgcagagcggggtcgacgtgttcttcacgccgcccgagaagtgcgacacgctgctctgcgacatcggcgagtccagccccaacccgaccatcgaggccggccgcaccctgcgggtgctgaacctcgtcgagaactggctgaacaacaacacccagttctgcatcaaggtgctgaacccctacatgccctccgtgatcgagaagatggaggccctgcagcgcaagtacgggggcgccctcgtccggaacccgctgagccgcaacagcacccacgagatgtactgggtgtccaacgcgagcgggaacatcgtgtccagcgtcaacatgatctcccggatgctgatcaaccgcttcacgatgcggcacaagaaggccacctacgagcccgacgtggacctcggcagcgggacccgcaacatcggcatcgagtccgagacccccaacctggacatcatcggcaagcgcatcgagaagatcaagcaggagcacgagacgagctggcactacgaccaggaccacccctacaagacctgggcctaccacgggtcctacgagaccaagcagaccggcagcgcctccagcatggtgaacggggtcgtgcggctgctcacgaagccgtgggacgtgatccccaccgtcacccagatggccatgaccgacacgacccccttcggccagcagcgcgtgttcaaggagaaggtggacacccggacccaggagcccaaggagggcacgaagaagctgatgaagatcaccgcggagtggctgtggaaggagctcgggaagaagaagaccccgcgcatgtgcacccgggaggagttcacgcgcaaggtccggtccaacgccgccctgggcgccatcttcaccgacgagaacaagtggaagtccgcccgcgaggcggtggaggactcccggttctgggagctggtcgacaaggagcgcaacctccacctggaggggaagtgcgagacctgcgtgtacaacatgatgggcaagcgggagaagaagctgggggagttcggcaaggccaagggcagccgcgccatctggtacatgtggctcggggcccggttcctggagttcgaggcgctgggcttcctcaacgaggaccactggttctcccgcgagaacagcctgtccggggtggagggcgaggggctgcacaagctcggctacatcctgcgggacgtcagcaagaaggagggcggggccatgtacgccgacgacaccgccggctgggacacgcgcatcaccctggaggacctcaagaacgaggagatggtgaccaaccacatggagggggagcacaagaagctggccgaggcgatcttcaagctgacctaccagaacaaggtggtccgggtgcagcgccccacgccccggggcaccgtgatggacatcatcagccgccgggaccagcgcgggtccggccaggtcggcacctacgggctcaacaccttcacgaacatggaggcccagctgatccgccagatggagggcgagggggtgttcaagagcatccagcacctgaccgtgaccgaggagatcgccgtccagaactggctcgcccgggtgggccgcgagcggctgtcccgcatggccatcagcggcgacgactgcgtggtcaagcccctggacgaccggttcgcgtccgccctcaccgccctgaacgacatggggaaggtgcgcaaggacatccagcagtgggagccgagccggggctggaacgactggacccaggtgcccttctgctcccaccacttccacgagctgatcatgaaggacgggcgcgtcctcgtggtgccctgccggaaccaggacgagctgatcggccgcgcccggatcagccagggggccggctggtccctgcgcgagaccgcgtgcctcggcaagagctacgcccagatgtggtccctgatgtacttccaccggcgcgacctgcggctcgccgccaacgccatctgcagcgcggtcccctcccactgggtgccgaccagccgcaccacctggtccatccacgcccggcacgagtggatgacgaccgaggacatgctgaccgtgtggaaccgcgtctggatccaggagaacccctggatggaggacaagacccccgtggagagctgggaggagatcccctacctggggaagcgggaggaccagtggtgcggctccctcatcgggctgacgagccgcgccacctgggccaagaacatccagaccgcgatcaaccaggtgcgcagcctgatcggcaacgaggagtacaccgactacatgccgtccatgaagcggttccgccgggaggaggaggaggccggggtcctctggtga

SEQ ID NO: 9745 - RNA, 9876 nt, synthetic construct
  misc_feature 1..9876: note = derived and/or modified CDS sequence (opt1) from DENV-2__GQ398313__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggccgtctccttcgtgaccctgatcacggggaacatgagcttccgggacctcggccgcgtgatggtcatggtgggggccaccatgaccgacgacatcggcatgggcatcacctacctggccctgctcgcggccttcaaggtgcgccccacgttcgccgccgggctgctgctccggaagctgacctccaaggagctgatgatggccaccatcggcatcgcgctcctgagccagtccaccatccccgagacgatcctggagctcaccgacgccctggccctggggatgatggtcctcaagatcgtgcgcaacatggagaagtaccagctggccgtgaccatcatggccatcagctgcgtcccgaacgcggtgatcctgcagaacgcctggaaggtgtcctgcaccatcctcgccgccgtcagcgtgagccccctgctgctcacgagctcccagcagaaggcggactggatccccctggccctgaccatcaagggcctcaaccccaccgccatcttcctgaccacgctgagccggacctccaagaagcgcagctggccgctcaacgaggccgtcatggccgtgggcatggtgtccatcctggcgagcagcctgctcaagaacgacatccccatgaccgggcccctggtcgccggcgggctgctcaccgtgtgctacgtgctgacgggccggtccgccgacctggagctcgagcgcgccgccgacgtcaagtgggaggaccaggcggagatcagcgggtccagccccatcctgtccatcaccatcagcgaggacggctccatgagcatcaagaacgaggaggaggagcagaccctgaccatcctcatccggacgggcctgctggtgatctccggggtgttcccggtcagcatccccatcaccgccgccgcctggtacctctgggaggtgaagaagcagcgcgccggcgtgctgtgggacgtccccagcccgccgcccgtggggaaggcggagctggaggacggcgcctaccggatcaagcagcgcgggatcctcggctacagccagatcggcgccggggtgtacaaggagggcaccttccacaccatgtggcacgtcacccgcggggcggtgctgatgcaccgcggcaagcggatcgagccctcctgggccgacgtgaagaaggacctgatcagctacgggggcggctggaagctcgagggggagtggaaggagggcgaggaggtccaggtgctggcgctggagcccgggaagaacccccgcgccgtgcagacgaagcccggcctcttcaagaccaacaccgggaccatcggcgccgtctccctggacttcagccccggcacgtccgggagccccatcgtggaccggaagggcaaggtggtcgggctgtacggcaacggcgtggtgacccgctccggggcctacgtcagcgcgatcgcccagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggcgccgacccgcgtggtcgccgccgagatggaggaggccctgcgggggctccccatccgctaccagacccccgccatccgggcggagcacacgggccgcgagatcgtggacctgatgtgccacgccaccttcaccatgcggctgctctcccccgtgcgcgtcccgaactacaacctgatcatcatggacgaggcccacttcaccgaccccgccagcatcgccgcgcggggctacatctccacgcgcgtggagatgggggaggccgccggcatcttcatgaccgccacgccgcccgggagccgggacccgttcccccagtccaacgcgcccatcatggacgaggagcgcgagatccccgagcggagctggaactccggccacgagtgggtgaccgacttcaaggggaagacggtctggttcgtgccgagcatcaaggccggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggcgaacttcaaggccgagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgcgagaaggtggacgccatcgacggggagtaccggctccgcggcgaggcccggaagacgttcgtggacctgatgcgccgcggggacctgcccgtctggctcgcctaccgcgtggcggccgagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggcgctgaaggagttcaaggagttcgccgccggccgcaagagcctcaccctgaacctgatcaccgagatggggcggctccccacgttcatgacccagaaggcccgcgacgccctggacaacctggcggtgctccacaccgccgaggccggcgggcgggcctacaaccacgccctgtccgagctgcccgagaccctcgagacgctgctgctcctgaccctgctcgcgaccgtcaccggcggcatcttcctgttcctgatgagcgggaagggcatcgggaagatgacgctcggcatgtgctgcatcatcaccgcctccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgcgatcctgaccgtggtggccgccacgatggccaacgagatggggttcctcgagaagaccaagaaggacctgggcctgggcagcatcgccacccaggagtccgagagcaacatcctcgacatcgacctgcggccggcgtccgcctggaccctgtacgccgtcgccacgaccttcgtgacccccatgctccgccacagcatcgagaactccagcgtgaacgtctccctgaccgcgatcgccaaccaggccacggtgctgatggggctcggcaaggggtggcccctgagcaagatggacatcggcgtgcccctgctcgccatcgggtgctactcccaggtcaacccgatcaccctgaccgccgcgctgctcctgctggtggcccactacgccatcatcggccccggcctccaggccaaggccacccgggaggcgcagaagcgcgccgccgccgggatcatgaagaaccccacggtggacggcatcaccgtcatcgacctggagcccatcccgtacgaccccaagttcgagaagcagctggggcaggtcatgctcctgatcctgtgcgtgacccaggtcctcatgatgcgcaccacgtgggccctgtgcgaggcgctgaccctcgccaccggccccatcagcaccctgtgggaggggaaccccggccggttctggaacacgaccatcgccgtgtccatggccaacatcttccgcggcagctacctggcgggggccggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtggaccgcaccctggccaaggagggcatcaagcgcggggagacggaccaccacgccgtctcccgcggcagcgcgaagctccggtggttcgtggagcgcaacatggtgaccccggagggcaaggtcgtggacctggggtgcggccgcggcgggtggtcctactactgcggcgggctgaagaacgtgcgcgaggtcaaggggctcaccaagggcgggcccgggcacgaggagcccatccccatgagcacctacggctggaacctggtgcggctgcagagcggggtggacgtcttcttcacgccgcccgagaagtgcgacaccctcctgtgcgacatcggcgagtccagccccaaccccaccatcgaggccggccgcaccctgcgggtgctcaacctggtggagaactggctgaacaacaacacgcagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgccaccgggaacatcgtgtccagcgtgaacatgatctcccggatgctcatcaaccgcttcaccatgaagcacaagaaggccacgtacgagccggacgtcgacctgggcagcgggacccgcaacatcggcatcgagtccgagatccccaacctggacatcatcggcaagcggatcgagaagatcaagcaggagcacgagaccagctggcactacgaccaggaccacccctacaagacctgggcgtaccacgggtcctacgagacgaagcagaccggcagcgcctccagcatggtgaacggggtggtccgcctcctgaccaagccctgggacgtggtgccgatggtcacccagatggccatgacggacaccacccccttcggccagcagcgggtgttcaaggagaaggtggacacccgcacgcaggagcccaaggagggcaccaagaagctgatgaagatcaccgccgagtggctctggaaggagctggggaagaagaagacgccccggatgtgcacgcgcgaggagttcacccggaaggtccgctccaacgccgcgctgggcgccatcttcaccgacgagaacaagtggaagtccgcccgggaggccgtggaggactcccgcttctgggagctcatcgaccgggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttcagccgcgggaactccctgagcggcgtcgagggggagggcctccaccggctgggctacatcctgcgcgacgtgtccaagaaggagggcggggccatgtacgcggacgacacggccgggtgggacacccggatcaccctcgaggacctgaagaacgaggagatggtcaccaaccacatgaagggcgagcacaagaagctggccgaggccatcttcaagctcacgtaccagaacaaggtggtgcgcgtccagcggccgacgccccgggggaccgtgatggacatcatcagccgccgggaccagcgcggctccggccaggtggggacctacggcctgaacacgttcaccaacatggaggcccagctgatccggcagatggagggggagggcatcttcaagagcatccagcacctcaccgtcaccgaggagatcgcggtgcagaactggctggcccgcgtgggccgggagcgcctgtcccggatggccatcagcggggacgactgcgtcgtgaagcccctcgacgaccgcttcgcctccgccctgacggcgctgaacgacatgggcaaggtgcggaaggacatccagcagtgggagcccagccgcgggtggaacgactggacccaggtcccgttctgctcccaccacttccacgagctcgtgatgaaggacggccgggtgctggtcgtgccctgccgcaaccaggacgagctgatcgggcgggcccgcatcagccagggcgccggctggtccctcaaggagaccgcctgcctgggcaagagctacgcccagatgtggaccctgatgtacttccaccggcgcgacctccggctggcggccaacgccatctgctccgccgtgcccagccactgggtccccacgtcccgcaccacctggagcatccacgcgaagcacgagtggatgaccaccgaggacatgctggccgtgtggaaccgggtgtggatccaggagaacccgtggatggaggacaagacgcccgtcgagagctgggaggaggtgccctacctcggcaagcgcgaggaccagtggtgcgggtccctgatcggcctgaccagccgcgccacctgggccaagaacatccagaccgccatcaaccaggtgcggtccctcatcgggaacgaggagtacacggactacatgcccagcatgaagcgcttccggcgcgaggaggaggaggcgggcgtcctgtggtga

SEQ ID NO: 9746 - RNA, 9876 nt, synthetic construct
  misc_feature 1..9876: note = derived and/or modified CDS sequence (opt1) from DENV-2__GQ398285__SS-prME
  source 1..9876: mol_type = other RNA
accgcgggcgtgatcatcatgctgatccccaccgccatggcgttccacctcaccacccgcaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggatgggcctggacttcaacgagatggtcctgctccagatggaggacaaggcctggctggtgcaccggcagtggttcctggacctccccctgccctggctgccgggggccgacacccagggcagcaactggatccagaaggagaccctcgtgacgttcaagaacccccacgcgaagaagcaggacgtcgtggtcctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcatggacctcgagaagcggcacgtgctggggcgcctgatcacggtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggccctgcaccaggtgttcggcaccatctacggcgcggccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggccgactccggctgcgtggtgagctggaagtccaaggagctgaagtgcggcagcgggatcttcatcaccgacaacgtccacacgtggaccgagcagtacaagttccagcccgagagcccctccaagctggcgagcgccatccagaaggcccacgaggagggcatctgcgggatccggtccgtgacccgcctcgagaacctgatgtggaagcagatcacccccgagctgaaccacatcctcagcgagaacgaggtgaagctgacgatcatgaccggcgggatcaagggcatcatgcaggccggcaagcggtccctgcgcccgcagcccaccgagctcaagtacagctggaagacctgggggaaggccaagatgctgtccacggagagccacaaccagaccttcctgatcgacggccccgagaccgcggagtgcccgaacaccaaccgggcctggaactccctcgaggtcgaggactacgggttcggcgtgttcacgaccaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggggtgctcgagtccgagatgatcatccccaagaacctggccggccccgtgagccagcacaactaccgcccggggtaccacacccagacggccggcccctggcacctggggaagctcgagatggacttcgacttctgcgagggcaccaccgtggtggtcaccgaggactgcggcaaccgggggcccagcctgcgcacgaccaccgcgtccggcaagctggtgaccgagtggtgctgccggagctgcacgctcccgcccctgcgctaccgcggggaggacggctgctggtacgggatggagatccgccccctgaaggagaaggaggagaacctcgtgaactccctggtcaccgccggccacggccagatcgacaacttcagcctgggggtgctcggcatggccctgttcctggaggagatgctccggacccgcgtggggaccaagcacgccatcctgctggtcgcggtgtccttcgtgacgctcatcaccggcaacatgagcttccgggacctggggcgcgtcatggtgatggtgggcgccaccatgaccgacgacatcggcatgggggtcacgtacctggccctcctggccgccttcaaggtgcgccccaccttcgcggccggcctgctcctgcggaagctgacctccaaggagctcatgatggccaccatcgggatcgccctgctgagccagtccacgatccccgagaccatcctcgagctgaccgacgccctggcgctcggcatgatggtgctgaagatcgtccgcaacatggagaagtaccagctggccgtgaccatcatggccatcagctgcgtgcccaacgccgtcatcctccagaacgcctggaaggtgtcctgcacgatcctggcggccgtcagcgtgagccccctgctcctgaccagctcccagcagaaggccgactggatccccctggccctcaccatcaagggcctgaaccccaccgcgatcttcctgacgaccctcagccggacctccaagaagcgcagctggccgctgaacgaggccatcatggccgtggggatggtctccatcctggccagcagcctcctgaagaacgacatccccatgaccggccccctggtggccgggggcctcctgacggtgtgctacgtcctgaccgggcggtccgcggacctcgagctggagcgcgccgccgacgtgaagtgggaggaccaggccgagatcagcggctccagccccatcctgtccatcaccatcagcgaggacggctccatgagcatcaagaacgaggaggaggagcagaccctcacgatcctgatccggaccgggctgctcgtgatctccggcgtcttcccggtgagcatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagcgcggcatcctgggctacagccagatcggggcgggcgtctacaaggaggggaccttccacaccatgtggcacgtgacgcggggcgccgtgctgatgcaccgcgggaagcggatcgagccctcctgggccgacgtcaagaaggacctcatcagctacggcggcgggtggaagctggagggcgagtggaaggagggggaggaggtccaggtgctggccctcgagcccggcaagaacccccgcgccgtccagaccaagcccgggctgttcaagaccaacaccggcacgatcggcgcggtgtccctggacttcagccccgggacctccggcagccccatcgtggaccggaaggggaaggtcgtgggcctctacggcaacggggtggtcacccgctccggcgcctacgtgagcgccatcgcccagaccgagaagtccatcgaggacaaccccgagatcgaggacgacatcttccggaagaagcgcctgacgatcatggacctgcaccccggggcgggcaagaccaagcggtacctgcccgccatcgtgcgcgaggccatcaagcgggggctccgcaccctgatcctggccccgacccgcgtcgtggccgcggagatggaggaggccctccggggcctgcccatccgctaccagacgcccgccatccgggccgagcacaccggccgcgagatcgtggacctgatgtgccacgccaccttcaccatgcggctcctgtcccccgtccgcgtgccgaactacaacctgatcatcatggacgaggcgcacttcacggaccccgccagcatcgccgcccgggggtacatctccacccgcgtggagatgggcgaggccgcggggatcttcatgaccgccacgccgcccggcagccgggacccgttcccccagtccaacgcccccatcatggacgaggagcgcgagatccccgagcggagctggaactccgggcacgagtgggtcacggacttcaagggcaagaccgtgtggttcgtgccgagcatcaaggccggcaacgacatcgcggcctgcctccgcaagaacgggaagaaggtcatccagctgtcccggaagaccttcgacagcgagtacgtgaagacccgcgccaacgactgggacttcgtggtcacgaccgacatctccgagatgggcgccaacttcaaggccgagcgggtgatcgacccccgccggtgcatgaagcccgtgatcctgaccgacggggaggagcgcgtcatcctcgcgggccccatgccggtgacccacagctccgccgcccagcggcgcgggcgcatcggccggaaccccaagaacgagaacgaccagtacatctacatgggcgagcccctggagaacgacgaggactgcgcccactggaaggaggccaagatgctgctcgacaacatcaacacgcccgaggggatcatcccgagcatgttcgagcccgagcgcgagaaggtggacgcgatcgacggcgagtaccggctgcgcggggaggcccggaagaccttcgtcgacctgatgcgccggggcgacctccccgtgtggctggcctaccgcgtggccgccgaggggatcaactacgcggaccggcgctggtgcttcgacggcatcaagaacaaccagatcctggaggagaacgtcgaggtggagatctggaccaaggagggcgagcggaagaagctcaagccgcgctggctggacgcccggatctactccgaccccctggccctcaaggagttcaaggagttcgccgcggggcgcaagagcctgaccctgaacctcatcacggagatgggccggctgcccaccttcatgacccagaaggcccgcaacgccctggacaacctcgccgtcctgcacaccgccgaggccggcgggcgggcctacaaccacgccctgtccgagctccccgagacgctggagaccctgctcctgctgaccctcctggccaccgtgacgggcgggatcttcctgttcctcatgagcgggaaggggatcggcaagatgaccctggggatgtgctgcatcatcaccgcctccatcctgctctggtacgcgcagatccagccgcactggatcgccgccagcatcatcctggagttcttcctgatcgtgctcctgatccccgagcccgagaagcagcgcacgccccaggacaaccagctgacctacgtcgtgatcgccatcctcacggtggtcgccgcgaccatggccaacgagatgggcttcctggagaagaccaagaaggacctgggcctcgggagcatcaccacgcaggagtccgagagcaacatcctggacatcgacctgcggccggcctccgcctggaccctctacgccgtggcgaccaccttcgtgacgcccatgctgcgccacagcatcgagaactccagcgtcaacgtgtccctgaccgccatcgccaaccaggccaccgtgctcatgggcctggggaagggctggcccctgagcaagatggacatcggggtccccctcctggcgatcggctgctactcccaggtgaacccgatcaccctgacggccgccctcctgctgctcgtggcccactacgccatcatcggccccgggctgcaggcgaaggccacccgggaggcccagaagcgcgccgccgcgggcatcatgaagaaccccaccgtcgacgggatcaccgtgatcgacctggagcccatcccgtacgaccccaagttcgagaagcagctcggccaggtgatgctgctgatcctctgcgtcacccaggtgctgatgatgcgcaccacctgggccctgtgcgaggccctcaccctggccacggggcccatcagcaccctgtgggagggcaaccccggccggttctggaacaccaccatcgccgtgtccatggcgaacatcttccgcgggagctacctcgccggcgccgggctgctgttctccatcatgaagaacacgaccaacacccggcgcggcaccggcaacatcggggagacgctcggcgagaagtggaagtcccggctgaacgccctgggcaagagcgagttccagatctacaagaagtccgggatccaggaggtcgaccgcaccctcgcgaaggaggggatcaagcggggcgagaccgaccaccacgccgtgtcccgcggcagcgccaagctgcggtggttcgtggagcgcaacatggtcaccccggaggggaaggtggtggacctgggctgcgggcggggcgggtggtcctactactgcggcggcctcaagaacgtccgcgaggtgaaggggctgacgaagggcgggcccggccacgaggagcccatccccatgagcacctacgggtggaacctggtgcggctccagagcggcgtcgacgtgttcttcaccccgcccgagaagtgcgacaccctgctgtgcgacatcggcgagtccagccccaaccccacgatcgaggccgggcgcaccctccgggtgctgaacctggtcgagaactggctcaacaacaacacccagttctgcatcaaggtgctgaacccgtacatgccctccgtgatcgagaagatggagaccctgcagcgcaagtacggcggggccctggtccggaaccccctcagccgcaactccacccacgagatgtactgggtgagcaacgcgacgggcaacatcgtgtccagcgtcaacatgatctcccggatgctgatcaaccgcttcaccatgaagcacaagaaggccacctacgagccggacgtggacctggggagcggcacccgcaacatcggcatcgagtccgagatccccaacctcgacatcatcgggaagcggatcgagaagatcaagcaggagcacgagacgagctggcactacgaccaggaccacccctacaagacctgggcctaccacggctcctacgagaccaagcagaccgggagcgcctccagcatggtgaacggcgtcgtgcgcctgctgacgaagccctgggacgtggtcccgatggtgacccagatggccatgaccgacaccacgcccttcggccagcagcgggtgttcaaggagaaggtcgacacccgcacccaggagcccaaggaggggaccaagaagctcatgaagatcacggcggagtggctgtggaaggagctgggcaaggagaagacgccccggatgtgcacccgcgaggagttcgcccggaaggtgcgctccaacgccgccctcggggccatcttcaccgacgagaacaagtggaagtccgcgcgggaggccgtggaggactcccgcttctgggagctgatcgaccgggagcgcaacctgcacctcgagggcaagtgcgagacgtgcgtctacaacatgatggggaagcgggagaagaagctgggcgagttcggcaaggccaaggggagccgcgccatctggtacatgtggctgggcgcgcggttcctcgagttcgaggccctggggttcctgaacgaggaccactggttcagccgcgagaactccctcagcggcgtggagggggagggcctgcaccggctgggctacatcctccgcgacgtctccaagaaggagggcggggccatgtacgccgacgacaccgccgggtgggacacccggatcaccctggaggacctgaagaacgaggagatggtgacgaaccacatgaagggcgagcacaagaagctcgcggaggccatcttcaagctgacctaccagaacaaggtggtccgcgtgcagcggccgacgccccgcgggaccgtgatggacatcatcagccgccgggaccagcgcggctccggccaggtcgggacctacggcctgaacaccttcaccaacatggaggcccagctcatccggcagatggagggggagggcatcttcaagagcatccagcacctgaccgccacggaggagatcgccgtgcagaactggctggcgcgcgtgggccgggagcgcctctcccggatggccatcagcggggacgactgcgtcgtgaagcccctggacgaccgcttcgcctccgccctgaccgccctcaacgacatgggcaaggtgcggaaggacatccagcagtgggagcccagccgcgggtggaacgactggacccaggtcccgttctgctcccaccacttccacgagctggtgatgaaggacggccgggtgctggtcgtgccctgccgcaaccaggacgagctcatcgggcgggcgcgcatcagccagggcgccggctggtccctgaaggagaccgcctgcctgggcaagagctacgcccagatgtggacgctcatgtacttccaccggcgcgacctgcggctggccgcgaacgccatctgctccgccgtgcccagccactgggtccccacctcccgcaccacctggagcatccacgccaagcacgagtggatgaccacggaggacatgctcgcggtgtggaaccgggtgtggatccaggagaacccgtggatggaggacaagacccccgtcgagagctgggaggaggtgccctacctgggcaagcgcgaggaccagtggtgcgggtccctgatcggcctcaccagccgcgccacctgggccaagaacatccagacggccatcaaccaggtgcggtccctgatcgggaacgaggagtacaccgactacatgcccagcatgaagcgcttccggcgcgaggaggaggaggccggcgtcctgtggtga

SEQ ID NO: 9747 - RNA, 9876 nt, synthetic construct
  misc_feature 1..9876: note = derived and/or modified CDS sequence (opt1) from DENV-2__GQ398298__SS-prME
  source 1..9876: mol_type = other RNA
accgccggggtgatcatcatgctgatccccaccgccatggcgttccacctcaccacccgcaacggggagccccacatgatcgtcgggcggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcctgctcgggatggcgctgttcctggaggagatgctccggacccgcgtcggcaccaagcacgccatgctgctggtggtggtctccttcgtgaccctcatcacggggaacatgagcttccgggacctgggccgcgtgatggtcatggtgggggccaccatgaccgacgacatcggcatgggcatcacctacctggccctcctggccgcgttcaaggtgcgccccacgttcgccgccgggctgctcctgcggaagctgacctccaaggagctcatgatggccaccatcggcatcgccctgctgagccagtccaccatccccgagacgatcctcgagctgaccgacgcgctggccctcgggatgatggtcctgaagatcgtgcgcaacatggagaagtaccagctggccgtgaccatcatggccatcagctgcgtcccgaacgccgtgatcctccagaacgcgtggaaggtgtcctgcaccatcctggccgccgtcagcgtgagccccctgctcctgacgagctcccagcagaaggccgactggatccccctggcgctcaccatcaagggcctgaaccccaccgccatcttcctgaccacgctcagccggacctccaagaagcgcagctggccgctgaacgaggccatcatggccgtcggcatggtgtccatcctggccagcagcctcctgaagaacgacatccccatgaccgggcccctggtggcgggcgggctcctgaccgtctgctacgtgctgacgggccggtccgccgacctcgagctggagcgcgccgccgacgtgaagtgggaggaccaggccgagatcagcgggtccagccccatcctgtccatcaccatcagcgaggacggctccatgagcatcaagaacgaggaggaggagcagaccctcaccatcctgatccggacgggcctgctcgtcatctccggggtgttcccggtgagcatccccatcaccgcggccgcctggtacctgtgggaggtcaagaagcagcgcgccggcgtgctgtgggacgtgcccagcccgccgcccgtcgggaaggccgagctcgaggacggcgcgtaccggatcaagcagcgcgggatcctgggctacagccagatcggcgccggggtgtacaaggagggcaccttccacaccatgtggcacgtgacccgcggggccgtcctgatgcaccgcggcaagcggatcgagccctcctgggccgacatcaagaaggacctcatcagctacgggggcggctggaagctggagggggagtggaaggagggcgaggaggtccaggtgctggccctcgagcccgggaagaacccccgcgcggtccagacgaagcccggcctgttcaagaccaacaccgggaccatcggcgccgtgtccctggacttcagccccggcacgtccgggagccccatcgtggaccggaagggcaaggtcgtggggctctacggcaacggcgtggtcacccgctccggggcctacgtgagcgccatcgcgcagaccgagaagtccatcgaggacaaccccgagatcgaggacgacatcttccggaagaagcgcctgaccatcatggacctgcaccccggcgccgggaagacgaagcggtacctgcccgccatcgtgcgcgaggccatcaagcggggcctccgcaccctgatcctggccccgacccgcgtcgtggcggccgagatggaggaggccctccgggggctgcccatccgctaccagacccccgccatccgggccgagcacacgggccgcgagatcgtggacctgatgtgccacgcgaccttcaccatgcggctcctgtcccccgtccgcgtgccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggcgggcaacgacatcgccgcctgcctccgcaagaacggcaagaaggtcatccagctgtcccggaagaccttcgacagcgagtacgtgaagacccgcgccaacgactgggacttcgtggtcaccacggacatctccgagatgggggccaacttcaaggcggagcgggtgatcgacccccgccggtgcatgaagcccgtgatcctgaccgacggcgaggagcgcgtcatcctcgccgggcccatgccggtgacccacagctccgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgagcatgttcgagcccgagcgcgagaaggtggacgccatcgacggggagtaccggctgcgcggcgaggcccggaagacgttcgtcgacctgatgcgccgcggggacctccccgtgtggctggcctaccgcgtggccgcggagggcatcaactacgccgaccggcgctggtgcttcgacgggatccggaacaaccagatcctggaggagaacgtcgaggtggagatctggaccaaggagggcgagcgcaagaagctcaagccgcggtggctggacgcccgcatctactccgaccccctggccctcaaggagttcaaggagttcgcggccggccggaagtccctgaccctgaacctcatcaccgagatggggcgcctgcccacgttcatgacccagaaggcccgggacgccctggacaacctcgccgtgctgcacaccgcggaggccggcgggcgcgcctacaaccacgccctgtccgagctccccgagaccctggagacgctgctcctgctgaccctcctggccaccgtcaccggcggcatcttcctgttcctcatgagcgggaagggcatcgggaagatgacgctgggcatgtgctgcatcatcaccgcgtccatcctgctctggtacgcccagatccagccgcactggatcgccgccagcatcatcctggagttcttcctgatcgtgctcctgatccccgagcccgagaagcagcggacgccccaggacaaccagctgacctacgtcgtgatcgccatcctcaccgtggtcgcggccacgatggccaacgagatggggttcctggagaagaccaagaaggacctgggcctcggcagcatcgccacccaggagtccgagagcaacatcctggacatcgacctgcgcccggcctccgcgtggaccctctacgccgtggccacgaccttcgtgacccccatgctgcggcacagcatcgagaactccagcgtcaacgtgtccctgaccgccatcgcgaaccaggccacggtgctcatggggctgggcaaggggtggcccctgagcaagatggacatcggcgtccccctcctggccatcgggtgctactcccaggtgaacccgatcaccctgaccgccgccctcctgctgctcgtggcgcactacgccatcatcggccccggcctgcaggccaaggccacccgcgaggcccagaagcgcgcggccgccgggatcatgaagaaccccacggtcgacggcatcaccgtgatcgacctggagcccatcccgtacgaccccaagttcgagaagcagctcggccaggtgatgctgctgatcctctgcgtcacccaggtgctgatgatgcggaccacgtgggccctgtgcgaggccctcaccctggcgaccggccccatcagcaccctgtgggaggggaaccccggccgcttctggaacacgaccatcgccgtgtccatggccaacatcttccggggcagctacctcgccggggcgggcctgctgttctccatcatgaagaacaccaccaacacgcgccgggggaccggcaacatcggcgagaccctcggggagaagtggaagtcccgcctgaacgccctgggcaagtccgagttccagatctacaagaagtccgggatccaggaggtcgaccggaccctcgccaaggagggcatcaagcgcggggagacggaccaccacgccgtgtcccggggcagcgccaagctgcgctggttcgtggagcggaacatggtcaccccggagggcaaggtggtggacctggggtgcggccgcgggggctggtcctactactgcgggggcctcaagaacgtccgggaggtgaagggcctgaccaagggcgggcccgggcacgaggagcccatccccatgagcacctacggctggaacctggtgcgcctccagagcggggtcgacgtgttcttcacgccgcccgagaagtgcgacaccctgctgtgcgacatcggcgagtccagccccaaccccaccatcgaggcgggccggaccctccgcgtgctgaacctggtcgagaactggctcaacaacaacacgcagttctgcatcaaggtgctgaacccgtacatgccctccgtgatcgagaagatggagaccctgcagcggaagtacgggggcgccctggtccgcaaccccctcagccggaactccacccacgagatgtactgggtgagcaacgccaccgggaacatcgtgtccagcgtcaacatgatctcccgcatgctgatcaaccgcttcaccatgaagcacaagaaggccacgtacgagccggacgtggacctgggcagcgggacccggaacatcggcatcgagtccgagatccccaacctcgacatcatcggcaagcgcatcgagaagatcaagcaggagcacgagaccagctggcactacgaccaggaccacccctacaagacctgggcctaccacgggtcctacgagacgaagcagaccggcagcgcgtccagcatggtgaacggggtcgtgcggctgctgaccaagccctgggacgtggtcccgatggtgacccagatggccatgacggacaccacccccttcggccagcagcgcgtgttcaaggagaaggtcgacacccggacgcaggagcccaaggagggcaccaagaagctcatgaagatcaccgccgagtggctgtggaaggagctggggaagaagaagacgccccggatgtgcacgcgggaggagttcacccgcaaggtgcggtccaacgccgccctcggcgcgatcttcaccgacgagaacaagtggaagtccgcccgcgaggccgtggaggactcccggttctgggagctgatcgaccgcgagcggaacctgcacctcgaggggaagtgcgagacctgcgtctacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttcagccgggggaactccctcagcggcgtggagggggagggcctgcaccgcctgggctacatcctccgggacgtgtccaagaaggagggcggggccatgtacgccgacgacacggcggggtgggacacccgcatcaccctggaggacctgaagaacgaggagatggtcaccaaccacatgaagggcgagcacaagaagctcgccgaggccatcttcaagctgacgtaccagaacaaggtggtccgggtgcagcgcccgacgccccgcgggaccgtgatggacatcatcagccggcgcgaccagcggggctccggccaggtcgggacctacggcctgaacacgttcaccaacatggaggcccagctcatccgccagatggagggggagggcatcttcaagagcatccagcacctgaccgtgaccgaggagatcgccgtgcagaactggctggcgcgggtcggccgcgagcggctctcccgcatggccatcagcggggacgactgcgtggtgaagcccctggacgaccggttcgcctccgccctgacggccctcaacgacatgggcaaggtccgcaaggacatccagcagtgggagcccagccgggggtggaacgactggacccaggtgccgttctgctcccaccacttccacgagctggtgatgaaggacggccgcgtcctggtggtgccctgccggaaccaggacgagctcatcgggcgcgcgcggatcagccagggcgccggctggtccctgaaggagaccgcctgcctgggcaagagctacgcccagatgtggaccctcatgtacttccaccgccgggacctgcgcctggccgcgaacgccatctgctccgccgtccccagccactgggtgcccacgtcccggaccacctggagcatccacgccaagcacgagtggatgaccaccgaggacatgctcgcggtgtggaaccgcgtctggatccaggagaacccgtggatggaggacaagacgcccgtggagagctgggaggaggtgccctacctgggcaagcgcgaggaccagtggtgcgggtccctgatcggcctcaccagccgggccacctgggccaagaacatccagaccgccatcaaccaggtccgctccctgatcgggaacgaggagtacacggactacatgcccagcatgaagcggttccgccgggaggaggaggaggccggcgtgctgtggtga

SEQ ID NO: 9748 - RNA, 9876 nt, synthetic construct
  misc_feature 1..9876: note = derived and/or modified CDS sequence (opt1) from DENV-2__GQ398301__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggccgcctccttcgtcaccctgatcacggggaacatgagcttccgggacctcggccgcgtgatggtgatggtcggggccaccatgaccgacgacatcggcatgggcatcacctacctggcgctgctcgccgccttcaaggtgcgccccacgttcgccgccgggctgctgctccggaagctgacctccaaggagctgatgatggcgaccatcggcatcgccctcctgagccagtccaccatccccgagacgatcctggagctcaccgacgccctggccctggggatgatggtgctcaagatcgtccgcaacatggagaagtaccagctggccgtgaccatcatggcgatcagctgcgtgccgaacgccgtcatcctgcagaacgcctggaaggtgtcctgcaccatcctcgccgcggtgagcgtcagccccctgctgctcacgagctcccagcagaaggccgactggatccccctggccctgaccatcaagggcctcaaccccaccgccatcttcctgaccacgctgagccggacctccaagaagcgcagctggccgctcaacgaggccatcatggcggtgggcatggtctccatcctggccagcagcctgctcaagaacgacatccccatgaccgggcccctggtggccggcgggctgctcaccgtgtgctacgtcctgacgggccggtccgccgacctggagctcgagcgcgccgcggacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtcttcccggtgagcatccccatcaccgccgccgcctggtacctctgggaggtgaagaagcagcgcgcgggcgtcctgtgggacgtgcccagcccgccgcccgtggggaaggccgagctggaggacggcgcctaccggatcaagcagcgcgggatcctcggctacagccagatcggcgccggggtctacaaggagggcaccttccacaccatgtggcacgtgacccgcggggcggtgctgatgcaccgcggcaagcggatcgagccctcctgggcggacgtcaagaaggacctgatcagctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgccgtgtccctggacttcagccccggcacgtccgggagccccatcgtggaccggaagggcaaggtcgtggggctgtacggcaacggcgtggtcacccgctccggggcgtacgtgagcgccatcgcccagaccgagaagtccatcgaggacaaccccgagatcgaggacgacatcttccggaagaagcgcctcaccatcatggacctgcaccccggcgccgggaagacgaagcggtacctgcccgccatcgtgcgcgaggcgatcaagcggggcctgcgcaccctcatcctggccccgacccgcgtcgtggccgccgagatggaggaggccctgcgggggctccccatccgctaccagacccccgcgatccgggccgagcacacgggccgcgagatcgtggacctgatgtgccacgccaccttcaccatgcggctgctctcccccgtccgcgtgccgaactacaacctgatcatcatggacgaggcccacttcaccgaccccgccagcatcgcggcccggggctacatctccacgcgcgtggagatgggggaggccgccggcatcttcatgaccgcgacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgccgcctgcctgcgcaagaacggcaagaaggtcatccagctctcccggaagaccttcgacagcgagtacgtgaagacccgcgcgaacgactgggacttcgtggtcaccacggacatctccgagatgggggccaacttcaaggccgagcgggtgatcgacccccgccggtgcatgaagcccgtgatcctgaccgacggcgaggagcgcgtcatcctggccgggcccatgccggtgacccacagctccgccgcgcagcggcgcggccgcatcgggcggaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgcgagaaggtggacgccatcgacggggagtaccggctccgcggcgaggcccggaagacgttcgtcgacctgatgcgccgcggggacctgcccgtgtggctcgcgtaccgcgtggccgccgagggcatcaactacgccgaccggcgctggtgcttcgacgggatcaagaacaaccagatcctggaggagaacgtcgaggtggagatctggaccaaggagggcgagcggaagaagctgaagccgcgctggctcgacgcgcggatctactccgaccccctggccctgaaggagttcaaggagttcgccgccggccgcaagagcctcaccctgaacctgatcaccgagatggggcggctccccacgttcatgacccagaaggcccgcgacgcgctggacaacctggccgtgctccacaccgccgaggccggcgggcgggcctacaaccacgcgctgtccgagctgcccgagaccctcgagacgctgctgctcctgaccctgctcgccaccgtcaccggcggcatcttcctgttcctgatgagcgggaagggcatcgggaagatgacgctcggcatgtgctgcatcatcaccgcctccatcctgctgtggtacgcccagatccagccgcactggatcgccgcgagcatcatcctcgagttcttcctgatcgtgctgctcatccccgagcccgagaagcagcgcacgccccaggacaaccagctgacctacgtcgtgatcgccatcctgaccgtggtcgccgccacgatggccaacgagatggggttcctcgagaagaccaagaaggacctgggcctgggcagcatcgcgacccaggagtccgagagcaacatcctcgacatcgacctgcggccggcctccgcctggaccctgtacgccgtggcgacgaccttcgtgacccccatgctccgccacagcatcgagaactccagcgtcaacgtgtccctgaccgccatcgccaaccaggccacggtgctgatggggctcggcaaggggtggcccctgagcaagatggacatcggcgtccccctgctcgccatcgggtgctactcccaggtgaacccgatcaccctgaccgcggccctgctcctgctggtggcccactacgccatcatcggccccggcctccaggccaaggcgacccgggaggcccagaagcgcgccgccgccgggatcatgaagaaccccacggtcgacggcatcaccgtgatcgacctggagcccatcccgtacgaccccaagttcgagaagcagctgggccaggtgatgctcctgatcctgtgcgtcacccaggtgctcatgatgcgcaccacgtgggcgctgtgcgaggccctgaccctcgccaccggccccatcagcaccctgtgggaggggaaccccggccggttctggaacacgaccatcgccgtgtccatggcgaacatcttccgcggcagctacctggccggggccggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtcgaccgcaccctggccaaggagggcatcaagcgcggggagacggaccaccacgcggtgtcccgcggcagcgccaagctccggtggttcgtggagcgcaacatggtcaccccggagggcaaggtggtggacctggggtgcggccgcggcgggtggtcctactactgcggcgggctgaagaacgtccgcgaggtgaaggggctcaccaagggcgggcccgggcacgaggagcccatccccatgagcacctacggctggaacctggtgcggctgcagagcggggtcgacgtgttcttcacgccgcccgagaagtgcgacaccctcctgtgcgacatcggcgagtccagccccaaccccaccatcgaggccggccgcaccctgcgggtgctcaacctggtcgagaactggctgaacaacaacacgcagttctgcatcaaggtgctcaacccgtacatgccctccgtgatcgagaagatggagaccctgcagcgcaagtacgggggcgccctggtccggaaccccctgagccgcaactccacccacgagatgtactgggtgagcaacgccaccgggaacatcgtgtccagcgtcaacatgatctcccggatgctcatcaaccgcttcaccatgaagcacaagaaggcgacgtacgagccggacgtggacctgggcagcgggacccgcaacatcggcatcgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcctccagcatggtgaacggggtcgtgcgcctcctgaccaagccctgggacgtggtcccgatggtgacccagatggccatgacggacaccacccccttcggccagcagcgggtgttcaaggagaaggtcgacacccgcacgcaggagcccaaggagggcaccaagaagctgatgaagatcaccgccgagtggctctggaaggagctggggaaggagaagacgccccggatgtgcacgcgcgaggagttcacccggaaggtgcgctccaacgcggccctgggcgccatcttcaccgacgagaacaagtggaagtccgcccgggaggcggtggaggactcccgcttctgggagctcatcgaccgggagcgcaacctgcacctggaggggaagtgcgagacctgcgtctacaacatgatgggcaagcgggagaagaagctcggggagttcggcaaggccaagggcagccgcgccatctggtacatgtggctgggggcccggttcctggagttcgaggccctcggcttcctgaacgaggaccactggttcagccgcgggaactccctgagcggcgtggagggggagggcctccaccggctgggctacatcctgcgcgacgtgtccaagaaggagggcggggcgatgtacgccgacgacacggccgggtgggacacccggatcaccctcgaggacctgaagaacgaggagatggtcaccaaccacatgaagggcgagcacaagaagctggccgaggccatcttcaagctcacgtaccagaacaaggtggtccgcgtgcagcggccgacgccccgggggaccgtgatggacatcatcagccgccgggaccagcgcggctccggccaggtcgggacctacggcctgaacacgttcaccaacatggaggcgcagctgatccggcagatggagggggagggcatcttcaagagcatccagcacctcaccgtgaccgaggagatcgccgtgcagaactggctggcccgcgtcggccgggagcgcctgtcccggatggccatcagcggggacgactgcgtggtgaagcccctcgacgaccgcttcgcctccgcgctgacggccctgaacgacatgggcaaggtccggaaggacatccagcagtgggagcccagccgcgggtggaacgactggacccaggtgccgttctgctcccaccacttccacgagctcgtgatgaaggacggccgggtcctggtggtgccctgccgcaaccaggacgagctgatcgggcgggcccgcatcagccagggcgccggctggtccctcaaggagaccgcctgcctgggcaagagctacgcgcagatgtggaccctgatgtacttccaccggcgcgacctccggctggccgccaacgccatctgctccgcggtccccagccactgggtgcccacgtcccgcaccacctggagcatccacgccaagcacgagtggatgaccaccgaggacatgctggccgtgtggaaccgggtctggatccaggagaacccgtggatggaggacaagacgcccgtggagagctgggaggaggtgccctacctcggcaagcgcgaggaccagtggtgcgggtccctgatcggcctgaccagccgcgccacctgggccaagaacatccagaccgcgatcaaccaggtccggtccctcatcgggaacgaggagtacacggactacatgcccagcatgaagcgcttccggcgcgaggaggaggaggccggcgtgctgtggtga

SEQ ID NO: 9749 - RNA, 9876 nt, synthetic construct
  misc_feature 1..9876: note = derived and/or modified CDS sequence (opt1) from DENV-2__GQ398312__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccaccagcacctgggtgacctacgggacctgcaccaccacgggcgagcaccggcgcgagaagcggtccgtcgccctggtgccccacgtggggatgggcctcgagacccggaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcagcaccaacatctggctgaagctgcgcgagaagcaggacgtgttctgcgactccaagctcatgagcgccgcgatcaaggacaaccgggccgtccacgccgacatgggctactggatcgagtccgccctgaacgacacgtggaagatggagaaggccagcttcatcgaggtgaagtcctgccactggcccaagagccacaccctgtggtccaacggcgtgctcgagagcgagatgatcatccccaagaacttcgcggggcccgtcagccagcacaactaccgcccgggctaccacacccagaccgccgggccctggcacctgggcaagctggagatggacttcgacttctgcgaggggaccacggtggtggtcaccgaggactgcggcaaccggggcccctccctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacgcgcgtgggcaccaagcacgccatgctcctggtggccgtcagcttcgtgaccctgatcaccgggaacatgtccttccgggacctcggccgcgtgatggtcatggtgggggccacgatgaccgacgacatcggcatgggcatcacctacctggccctgctcgcggccttcaaggtgcgccccaccttcgccgccgggctgctgctccggaagctgacgagcaaggagctgatgatggccaccatcggcatcgcgctcctgtcccagagcaccatccccgagaccatcctggagctcacggacgccctggccctggggatgatggtcctcaagatcgtgcgcaacatggagaagtaccagctggccgtgaccatcatggccatctcctgcgtcccgaacgcggtgatcctgcagaacgcctggaaggtgagctgcaccatcctcgccgccgtctccgtgagccccctgctgctcacctccagccagcagaaggcggactggatccccctggccctgacgatcaagggcctcaaccccaccgccatcttcctgaccaccctgtcccggacgagcaagaagcgctcctggccgctcaacgaggccatcatggccgtcggcatggtgagcatcctggcgagctccctgctcaagaacgacatccccatgaccgggcccctggtggccggcgggctgctcaccgtctgctacgtgctgaccggccggagcgccgacctggagctcgagcgcgccgccgacgtgaagtgggaggaccaggcggagatctccgggagctcccccatcctgagcatcacgatctccgaggacggcagcatgtccatcaagaacgaggaggaggagcagaccctgaccatcctcatccggaccggcctgctggtcatcagcggggtgttcccggtgtccatccccatcacggccgccgcctggtacctctgggaggtcaagaagcagcgcgccggcgtgctgtgggacgtgcccagcccgccgcccgtcgggaaggcggagctggaggacggcgcctaccggatcaagcagcgcgggatcctcggctactcccagatcggcgccggggtgtacaaggagggcaccttccacaccatgtggcacgtgacccgcggggcggtcctgatgcaccgcggcaagcggatcgagcccagctgggccgacgtgaagaaggacctgatctcctacgggggcggctggaagctcgagggggagtggaaggagggcgaggaggtgcaggtcctggcgctggagcccgggaagaacccccgcgccgtgcagaccaagcccggcctcttcaagacgaacaccgggaccatcggcgccgtgagcctggacttctcccccggcaccagcgggtcccccatcgtcgaccggaagggcaaggtggtggggctgtacggcaacggcgtcgtgacgcgcagcggggcctacgtgagcgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtccgcgaggccatcaagcggggcctgcgcacgctcatcctggcgccgacccgcgtggtggccgccgagatggaggaggccctgcgggggctccccatccgctaccagacccccgccatccgggcggagcacaccggccgcgagatcgtcgacctgatgtgccacgccacgttcaccatgcggctgctcagccccgtgcgcgtgccgaactacaacctgatcatcatggacgaggcccacttcaccgaccccgcctccatcgccgcgcggggctacatcagcacccgcgtcgagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtgtggttcgtcccgtccatcaaggccggcaacgacatcgccgcctgcctgcgcaagaacggcaagaaggtgatccagctcagccggaagacgttcgactccgagtacgtgaagacccgcgccaacgactgggacttcgtcgtgaccaccgacatcagcgagatgggggcgaacttcaaggccgagcgggtgatcgacccccgccggtgcatgaagcccgtcatcctgacggacggcgaggagcgcgtgatcctggccgggcccatgccggtgacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtcgacgccatcgacggggagtaccggctccgcggcgaggcccggaagaccttcgtggacctgatgcgccgcggggacctgcccgtgtggctcgcctaccgcgtcgcggccgagggcatcaactacgccgaccggcgctggtgcttcgacgggatcaagaacaaccagatcctggaggagaacgtggaggtggagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcgacgccctggacaacctggcggtcctccacaccgccgaggccggcgggcgggcctacaaccacgccctgagcgagctgcccgagaccctcgagaccctgctgctcctgacgctgctcgcgaccgtgaccggcggcatcttcctgttcctgatgtccgggaagggcatcgggaagatgaccctcggcatgtgctgcatcatcacggccagcatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccaccatggccaacgagatggggttcctcgagaagacgaagaaggacctgggcctgggctccatcgccacccaggagagcgagtccaacatcctcgacatcgacctgcggccggcgagcgcctggaccctgtacgccgtggccaccacgttcgtcacccccatgctccgccactccatcgagaacagctccgtgaacgtgagcctgaccgcgatcgccaaccaggccaccgtcctgatggggctcggcaaggggtggcccctgtccaagatggacatcggcgtgcccctgctcgccatcgggtgctacagccaggtgaacccgatcacgctgatcgccgcgctgctcctgctggtcgcccactacgccatcatcggccccggcctccaggccaaggccacccgggaggcgcagaagcgcgccgccgccgggatcatgaagaaccccaccgtggacggcatcaccgtgatcgacctggagcccatcccgtacgaccccaagttcgagaagcagctggggcaggtcatgctcctgatcctgtgcgtgacccaggtcctcatgatgcgcaccacctgggccctgtgcgaggcgctgaccctcgccacgggccccatctccaccctgtgggaggggaaccccggccggttctggaacaccaccatcgccgtcagcatggccaacatcttccgcggctcctacctggcgggggccggcctcctgttcagcatcatgaagaacacgaccaacacccggcgcgggaccggcaacatcggcgagacgctgggggagaagtggaagtcccggctcaacgccctgggcaagagcgagttccagatctacaagaagtccgggatccaggaggtggaccgcaccctggccaaggagggcatcaagcgcggggagaccgaccaccacgccgtgagccgcggctccgcgaagctccggtggttcgtcgagcgcaacatggtgaccccggagggcaaggtggtcgacctggggtgcggccgcggcgggtggagctactactgcggcgggctgaagaacgtgcgcgaggtgaaggggctcacgaagggcgggcccgggcacgaggagcccatccccatgagcacctacggctggaacctggtccggctgcagtccggggtggacgtgttcttcaccccgcccgagaagtgcgacaccctcctgtgcgacatcggcgagagctcccccaaccccacgatcgaggccggccgcaccctgcgggtcctcaacctggtggagaactggctgaacaacaacacccagttctgcatcaaggtgctcaacccgtacatgcccagcgtcatcgagaagatggagaccctgcagcgcaagtacgggggcgccctggtgcggaaccccctgtcccgcaacagcacgcacgagatgtactgggtgtccaacgccaccgggaacatcgtcagctccgtgaacatgatcagccggatgctcatcaaccgcttcaccatgaagcacaagaaggccacctacgagccggacgtggacctgggctccgggacccgcaacatcggcatcgagagcgagatccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtcaacggggtggtgcgcctcctgacgaagccctgggacgtcgtgccgatggtgacccagatggccatgaccgacaccacgcccttcggccagcagcgggtcttcaaggagaaggtggacacccgcacccaggagcccaaggagggcaccaagaagctgatgaagatcacggccgagtggctctggaaggagctggggaagaagaagacgccccggatgtgcacccgcgaggagttcacccggaaggtgcgcagcaacgccgcgctgggcgccatcttcacggacgagaacaagtggaagtccgcccgggaggccgtcgaggacagccgcttctgggagctcatcgaccgggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgggaacagcctgtccggcgtggagggggagggcctccaccggctgggctacatcctgcgcgacgtcagcaagaaggagggcggcgccatgtacgcggacgacaccgccgggtgggacacccggatcacgctcgaggacctgaagaacgaggagatggtgaccaaccacatgaagggcgagcacaagaagctggccgaggccatcttcaagctcacctaccagaacaaggtcgtgcgcgtgcagcggccgacgccccgggggacggtcatggacatcatctcccgccgggaccagcgcggcagcggccaggtggggacctacggcctgaacaccttcaccaacatggaggcccagctgatccggcagatggagggggagggcatcttcaagtccatccagcacctcacggtgaccgaggagatcgcggtccagaactggctggcccgcgtgggccgggagcgcctgagccggatggccatctccggggacgactgcgtggtcaagcccctcgacgaccgcttcgccagcgccctgaccgcgctgaacgacatgggcaaggtgcggaaggacatccagcagtgggagccctcccgcgggtggaacgactggacccaggtgccgttctgcagccaccacttccacgagctcgtcatgaaggacggccgggtgctggtggtcccctgccgcaaccaggacgagctgatcgggcgggcccgcatctcccagggcgccggctggagcctcaaggagacggcctgcctggggaagtcctacgcccagatgtggaccctgatgtacttccaccggcgcgacctccggctggcggccaacgccatctgcagcgccgtgccctcccactgggtgcccaccagccgcaccacgtggagcatccacgcgaagcacgagtggatgaccaccgaggacatgctggccgtctggaaccgggtgtggatccaggagaacccgtggatggaggacaagacccccgtggagtcctgggaggaggtcccctacctcggcaagcgcgaggaccagtggtgcgggagcctgatcggcctgacctcccgcgccacgtgggccaagaacatccagaccgccatcaaccaggtgcggagcctcatcgggaacgaggagtacaccgactacatgccctccatgaagcgcttccggcgcgaggaggaggaggcgggcgtgctgtggtga

SEQ ID NO: 9750 - RNA, 9876 nt, synthetic construct
  misc_feature 1..9876: note = derived and/or modified CDS sequence (opt1) from DENV-2__GQ398289__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcgtgtgcaagcactccatggtggaccggggctgggggaacggctgcggcctcttcggcaagggcgggatcgtcacgtgcgccatgttcacgtgcaagaagaacatggagggcaaggtggtgctgcccgagaacctggagtacaccatcgtcatcacgccccacagcggggaggagcacgccgtgggcaacgacacggggaagcacggcaaggagatcaagatcaccccgcagtccagcatcaccgaggccgagctcaccgggtacggcaccgtgacgatggagtgcagcccccggaccggcctggacttcaacgagatggtcctgctccagatggaggacaaggcctggctggtgcaccggcagtggttcctggacctccccctgccctggctgccgggggcggacacccagggcagcaactggatccagaaggagaccctcgtgacgttcaagaacccccacgccaagaagcaggacgtcgtggtcctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtgaaggagatcgcggagacccagcacgggaccatcgtgatccgcgtccagtacgagggcgacggctccccctgcaagatccccttcgagatcatggacctcgagaagcggcacgtgctggggcgcctgatcacggtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacaccaaggggatcatgcaggcgggcaagcggtccctgcgcccgcagcccaccgagctcaagtacagctggaagacctggggcaaggccaagatgctgtccacggagagccacaaccagaccttcctgatcgacgggcccgagaccgccgagtgcccgaacaccaaccgggcctggaactccctcgaggtcgaggactacggcttcggggtgttcacgaccaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagacggccgggccctggcacctgggcaagctggagatggacttcgacttctgcgaggggaccaccgtggtggtcaccgaggactgcggcaaccggggccccagcctccgcacgaccaccgcctccgggaagctgatcaccgagtggtgctgccggagctgcacgctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacccgcgtgggcaccaagcacgccatcctcctgatcgccgtgtccttcgtcacgctgatcaccgggaacatgagcttccgggacctcggccgcgtgatggtgatggtcggggccaccatgaccgacgacatcggcatgggcgtgacgtacctggccctgctcgcggccttcaaggtgcgccccaccttcgccgccgggctgctgctccggaagctgacctccaaggagctgatgatggccaccatcggcatcgcgctcctgagccagtccacgatccccgagaccatcctggagctcaccgacgccctggccctggggatgatggtcctcaagatcgtgcgcaacatggagaagtaccagctggccgtgaccatcatggccatcagctgcgtcccgaacgcggtgatcctgcagaacgcctggaaggtgtcctgcacgatcctcgccgccgtcagcgtgagccccctgctgctcaccagctcccagcagaaggcggactggatccccctggccctgaccatcaagggcctcaaccccaccgccatcttcctgacgaccctgagccggacctccaagaagcgcagctggccgctcaacgaggccatcatggccgtcggcatggtgtccatcctggcgagcagcctgctcaagaacgacatccccatgaccgggcccctggtggccggcgggctgctcacggtctgctacgtgctgaccggccggtccgccgacctggagctcgagcgcgccgccgacgtgaagtgggaggaccaggcggagatcagcgggtccagccccatcctgtccatcaccatcagcgaggacggctccatgagcatcaagaacgaggaggaggagcagaccctgacgatcctcatccggaccggcctgctggtcatctccggggtgttcccggtgagcatccccatcaccgccgccgcctggtacctctgggaggtcaagaagcagcgcgccggcgtgctgtgggacgtgcccagcccgccgcccgtcgggaaggcggagctggaggacggcgcctaccggatcaagcagcgcgggatcctcggctacagccagatcggcgccggggtgtacaaggagggcaccttccacaccatgtggcacgtgacgcgcggggcggtcctgatgcaccgcggcaagcggatcgagccctcctgggccgacgtgaagaaggacctgatcagctacgggggcggctggaagctcgagggggagtggaaggagggcgaggaggtgcaggtcctggcgctggagcccgggaagaacccccgcgccgtgcagaccaagcccggcctcttcaagaccaacaccgggacgatcggcgccgtgtccctggacttcagccccggcacctccgggagccccatcgtcgaccggaagggcaaggtggtggggctgtacggcaacggcgtcgtgacccgctccggggcctacgtgagcgcgatcgcccagaccgagaagtccatcgaggacaaccccgagatcgaggacgacatcttccggaagaagcgcctcacgatcatggacctgcaccccggcgccgggaagaccaagcggtacctgcccgccatcgtccgcgaggccatcaagcggggcctgcgcaccctcatcctggcgccgacccgcgtggtggccgccgagatggaggaggccctgcgggggctccccatccgctaccagacgcccgccatccgggcggagcacaccggccgcgagatcgtcgacctgatgtgccacgccaccttcaccatgcggctgctctcccccgtgcgcgtgccgaactacaacctgatcatcatggacgaggcccacttcacggaccccgccagcatcgccgcgcggggctacatctccacccgcgtcgagatgggggaggccgccggcatcttcatgaccgccacgccgcccgggagccgggacccgttcccccagtccaacgcgcccatcatggacgaggagcgcgagatccccgagcggagctggaactccggccacgagtgggtgacggacttcaaggggaagaccgtgtggttcgtcccgagcatcaaggccggcaacgacatcgccgcctgcctgcgcaagaacggcaagaaggtgatccagctctcccggaagaccttcgacagcgagtacgtgaagacccgcgccaacgactgggacttcgtcgtgacgaccgacatctccgagatgggggcgaacttcaaggccgagcgggtgatcgacccccgccggtgcatgaagcccgtcatcctgaccgacggcgaggagcgcgtgatcctggccgggcccatgccggtgacccacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacgcccgagggcatcatcccgagcctcttcgagcccgagcgcgagaaggtcgacgccatcgacggggagtaccggctgcgcggcgaggcccggaagaccttcgtggacctgatgcgccgcggggacctccccgtgtggctggcctaccgcgtcgcggccgagggcatcaactacgccgaccggcgctggtgcttcgacgggatcaagaacaaccagatcctggaggagaacgtggaggtggagatctggaccaaggagggcgagcggaagaagctcaagccgcgctggctggacgcccggatctactccgaccccctggcgctcaaggagttcaaggagttcgccgccggccgcaagagcctgaccctgaacctcatcacggagatggggcggctgcccaccttcatgacccagaaggcccgcgacgccctggacaacctcgcggtcctgcacaccgccgaggccggcgggcgggcctacaaccacgccctgtccgagctccccgagacgctggagaccctgctcctgctgaccctcctggcgaccgtgacgggcggcatcttcctgttcctcatgagcgggcgcggcatcgggaagatgaccctgggcatgtgctgcatcatcaccgcctccatcctgctctggtacgcccagatccagccgcactggatcgccgccagcatcatcctggagttcttcctgatcgtcctcctgatccccgagcccgagaagcagcggacgccccaggacaaccagctgacctacgtggtgatcgcgatcctcacggtcgtggccgccaccatggccaacgagatggggttcctggagaagaccaagaaggacctgggcctcggcagcatcaccacgcaggagtccgagagcaacatcctggacatcgacctgcgcccggcctccgcgtggaccctctacgccgtggccaccaccttcgtcacgcccatgctgcggcacagcatcgagaactccagcgtgaacgtgtccctgaccgccatcgcgaaccaggccaccgtcctcatggggctgggcaaggggtggcccctgagcaagatggacatcggcgtgcccctcctggccatcgggtgctactcccaggtgaacccgatcaccctgacggccgccctcctgctgctcgtcgcgcactacgccatcatcggccccggcctgcaggccaaggccacccgcgaggcccagaagcgcgcggccgccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcggaccacctgggccctgtgcgaggccctcaccctggcgacgggccccatcagcaccctgtgggaggggaaccccggccgcttctggaacaccaccatcgccgtctccatggccaacatcttccggggcagctacctcgccggggcgggcctgctgttctccatcatgaagaacacgaccaacacccgccgggggaccggcaacatcggcgagacgctcggggagaagtggaagtcccgcctgaacgccctgggcaagtccgagttccagatctacaagaagtccgggatccaggaggtggaccggaccctcgccaaggagggcatcaagcgcggggagaccgaccaccacgccgtgtcccggggcagcgccaagctgcgctggttcgtcgagcggaacatggtgaccccggagggcaaggtggtcgacctggggtgcggccgcgggggctggtcctactactgcgggggcctcaagaacgtgcgggaggtgaagggcctgacgaagggcgggcccgggcacgaggagcccatccccatgagcacctacggctggaacctggtccgcctccagagcggggtggacgtgttcttcaccccgcccgagaagtgcgacaccctgctgtgcgacatcggcgagtccagccccaaccccacgatcgaggcgggccggaccctccgcgtcctgaacctggtggagaactggctcaacaacaacacccagttctgcatcaaggtgctgaacccgtacatgccctccgtcatcgagaagatggagaccctgcagcggaagtacgggggcgccctggtgcgcaaccccctcagccggaactccacccacgagatgtactgggtgagcaacgccacggggaacatcgtctccagcgtgaacatgatctcccgcatgctgatcaaccgcttcaccatgaagcacaagaaggccacctacgagccggacgtggacctgggcagcgggacccggaacatcggcatcgagtccgagatccccaacctcgacatcatcggcaagcgcatcgagaagatcaagcaggagcacgagacgagctggcactacgaccaggaccacccctacaagacctgggcctaccacgggtcctacgagaccaagcagaccggcagcgcgtccagcatggtcaacggggtggtgcggctgctgacgaagccctgggacgtcgtgccgatggtgacccagatggccatgaccgacaccacgcccttcggccagcagcgcgtcttcaaggagaaggtggacacccggacccaggagcccaaggagggcaccaagaagctcatgaagatcacggccgagtggctgtggaaggagctggggaagaagaagacgccccggatgtgcacccgggaggagttcacccgcaaggtgcggtccaacgccgccctcggcgcgatcttcacggacgagaacaagtggaagtccgcccgcgaggccgtcgaggactcccggttctgggagctgatcgaccgcgagcggaacctgcacctcgaggggaagtgcgagacctgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttcagccggcgcaactccctcagcggggtggagggcgaggggctgcaccggctgggctacatcctccgcgacgtctccaagaaggagggcggggccatgtacgccgacgacaccgcgggctgggacacccggatcacgctggaggacctgaagaacgaggagatggtgaccaaccacatgaagggggagcacaagaagctcgccgaggccatcttcaagctgacctaccagaacaaggtcgtgcgcgtgcagcgcccgacgccccggggcacggtcatggacatcatcagccgccgggaccagcgcgggtccggccaggtgggcacctacgggctgaacaccttcaccaacatggaggcccagctcatccggcagatggagggcgaggggatcttcaagagcatccagcacctgacggtgaccgaggagatcgccgtccagaactggctggcgcgcgtgggccgggagcgcctctcccggatggccatcagcggcgacgactgcgtggtcaagcccctggacgaccgcttcgcctccgccctgaccgccctcaacgacatggggaaggtgcggaaggacatccagcagtgggagcccagccgcggctggaacgactggacccaggtgccgttctgctcccaccacttccacgagctggtcatgaaggacgggcgggtgctggtggtcccctgccgcaaccaggacgagctcatcggccgggcgcgcatcagccagggggccggctggtccctgaaggagacggcctgcctgggcaagagctacgcccagatgtggaccctcatgtacttccaccggcgcgacctgcggctggccgcgaacgccatctgctccgccgtgcccagccactgggtgcccacctcccgcaccacctggagcatccacgccaagcacgagtggatgacgaccgaggacatgctcgcggtctggaaccgcgtgtggatccaggagaacccgtggatggaggacaagacccccgtggagagctgggaggaggtcccctacctggggaagcgggaggaccagtggtgcggctccctgatcgggctcaccagccgcgccacgtgggccaagaacatccagaccgccatcaaccaggtgcggtccctgatcggcaacgaggagtacaccgactacatgcccagcatgaagcgcttccggcgcgaggaggaggaggccggggtgctgtggtga

SEQ ID NO: 9751 - RNA, 9876 nt, synthetic construct
  misc_feature 1..9876: note = derived and/or modified CDS sequence (opt1) from DENV-2__GQ398290__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcgggctgttcggcaagggcgggatcgtgacctgcgcgatgttcacgtgcaagaagaacatggagggcaaggtggtgctgcccgagaacttcgagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggccatggtccaggcggactccggctgcgtggtgagctggaagtccaaggagctcaagtgcggcagcgggatcttcatcaccgacaacgtccacacgtggaccgagcagtacaagttccagcccgagagcccctccaagctggccagcgccatccagaaggcccacgaggagggcatctgcgggatccggtccgtgacccgcctggagaacctcatgtggaagcagatcacccccgagctgaaccacatcctgagcgagaacgaggtgaagctcacgatcatgaccggcgacatcaaggggatcatgcaggccggcaagcggtccctgcgcccgcagcccaccgagctgaagtacagctggaagacctggggcaaggcgaagatgctctccacggagagccacaaccagaccttcctgatcgacgggcccgagaccgccgagtgcccgaacaccaaccgggcctggaactccctggaggtcgaggactacggcttcggggtgttcacgaccaacatctggctcaagctgcgcgagaagcaggacgtgttctgcgacagcaagctgatgtccgccgccatcaaggacaaccgggcggtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagacggcggggccctggcacctcggcaagctggagatggacttcgacctgtgcgaggggaccaccgtggtggtcaccgagaactgcggcaaccggggccccagcctccgcacgaccaccgcctccgggaagctgatcaccgagtggtgctgccggagctgcacgctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacccgcgtgggcaccaagcacgcgatcctcctggtggccgtctccttcgtgacgctgatcaccgggaacatgagcttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgacctccaaggagctgatgatggccaccatcggcatcgccctcctgagccagtccacgatccccgagaccatcctggagctcaccgacgcgctggccctggggatgatggtgctcaagatcgtgcgcaacatggagaagtaccagctggccgtcaccatcatggccatcagctgcgtgccgaacgccgtgatcctgcagaacgcgtggaaggtctcctgcacgatcctcgccgccgtgagcgtcagccccctgctgctcaccagctcccagcagaaggccgactggatccccctggcgctgaccatcaagggcctcaaccccaccgccatcttcctgacgaccctgagccggacctccaagaagcgcagctggccgctcaacgaggccatcatggccgtgggcatggtgtccatcctggccagcagcctgctcaagaacgacatccccatgaccgggcccctggtcgcgggcgggctgctcacggtgtgctacgtgctgaccggccggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgacgatcctcatccggaccggcctgctggtgatctccggggtgttcccggtcagcatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctacagccagatcggcgccggggtgtacaaggagggcaccttccacaccatgtggcacgtcacgcgcggggccgtgctgatgcaccgcggcaagcggatcgagccctcctgggccgacgtgaagaaggacctgatcagctacgggggcggctggaagctcgagggggagtggaaggagggcgaggaggtccaggtgctggccctggagcccgggaagaacccccgcgcggtgcagaccaagcccggcctcttcaagaccaacaccgggacgatcggcgccgtctccctggacttcagccccggcacctccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcacgatcatggacctgcaccccggcgccgggaagaccaagcggtacctgcccgccatcgtgcgcgaggccatcaagcggggcctgcgcaccctcatcctggccccgacccgcgtggtcgcggccgagatggaggaggccctgcgggggctccccatccgctaccagacgcccgccatccgggccgagcacaccggccgcgagatcgtggacctgatgtgccacgcgaccttcaccatgcggctgctctcccccgtgcgcgtcccgaactacaacctgatcatcatggacgaggcccacttcacggaccccgccagcatcgccgcccggggctacatctccacccgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgacgaccgacatctccgagatgggggccaacttcaaggcggagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacgcccgagggcatcatcccgagcatgttcgagcccgagcgcgagaaggtggacgccatcgacggggagtaccggctccgcggcgaggcccggaagaccttcgtggacctgatgcgccgcggggacctgcccgtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcacggagatggggcggctccccaccttcatgacccagaaggcccgcgacgccctggacaacctggccgtgctccacaccgcggaggccggcgggcgggcctacaaccacgccctgtccgagctgcccgagacgctcgagaccctgctgctcctgaccctgctcgccaccgtcacgggcggcatcttcctgttcctgatgagcgggcgcggcatcgggaagatgaccctcggcatgtgctgcatcatcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgccatcctgacggtggtggcggccaccatggccaacgagatggggttcctcgagaagaccaagaaggacctgggcctgggcagcatcaccacgcaggagtccgagagcaacatcctcgacatcgacctgcgcccggcctccgcctggaccctgtacgcggtcgccaccaccttcgtgacgcccatgctccggcacagcatcgagaactccagcgtgaacgtctccctgaccgccatcgccaaccaggcgaccgtgctgatggggctcggcaaggggtggcccctgagcaagatggacatcggcgtgcccctgctcgccatcgggtgctactcccaggtcaacccgatcaccctgacggccgccctgctcctgctggtggcccactacgcgatcatcggccccggcctccaggccaaggccacccgcgaggcccagaagcgcgccgcggccgggatcatgaagaaccccaccgtggacggcatcaccgtcatcgacctggagcccatcccgtacgaccccaagttcgagaagcagctggggcaggtcatgctcctgatcctgtgcgtgacgcaggtcctcatgatgcggaccacctgggccctgtgcgaggccctgaccctcgccacgggccccatcagcaccctgtgggaggggaaccccggccgcttctggaacaccaccatcgcggtgtccatggccaacatcttccggggcagctacctggccggggccggcctcctgttctccatcatgaagaacacgaccaacacccgccgggggaccggcaacatcggcgagacgctgggggagaagtggaagtcccgcctcaacaccctgggcaagtccgagttccagatctacaagaagtccgggatccaggaggtggaccggaccctggcgaaggagggcatcaagcgcggggagaccgaccaccacgccgtctcccggggcagcgccaagctccgctggttcgtggagcggaacatggtgacgccggagggcaaggtcgtggacctggggtgcggccgcgggggctggtcctactactgcgggggcctgaagaacgtgcgggaggtcaagggcctcaccaagggcgggcccgggcacgaggagcccatccccatgagcacctacggctggaacctggtgcgcctgcagagcggggtggacgtcttcttcaccccgcccgagaagtgcgacacgctcctgtgcgacatcggcgagtccagccccaaccccaccatcgaggccggccggaccctgcgcgtgctcaacctggtggagaactggctgaacaacaacacccagttctgcatcaaggtcctcaacccgtacatgccctccgtgatcgagaagatggagaccctgcagcggaagtacgggggcgccctggtgcgcaaccccctgagccggaactccacgcacgagatgtactgggtcagcaacgcgaccgggaacatcgtgtccagcgtgaacatgatctcccgcatgctcatcaaccgcttcaccatgaagcacaagaaggccacctacgagccggacgtcgacctgggcagcgggacgcggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcctccagcatggtgaacggggtggtccggctcctgaccaagccctgggacgtggtgccgatggtcacccagatggccatgaccgacacgacccccttcggccagcagcgcgtgttcaaggagaaggtggacacccggacccaggagcccaaggagggcacgaagaagctgatgaagatcaccgcggagtggctctggaaggagctggggaagaagaagacgccccggatgtgcacccgggaggagttcacgcgcaaggtccggtccaacgccgccctgggcgccatcttcaccgacgagaacaagtggaagtccgcccgcgaggcggtggaggactcccggttctgggagctcatcgaccgcgagcggaacctgcacctggaggggaagtgcgagacctgcgtgtacaacatgatgggcaagcgcgagaagaagctcggggagttcggcaaggccaagggcagccgggccatctggtacatgtggctgggggcccgcttcctggagttcgaggcgctcggcttcctgaacgaggaccactggttcagccgggggaactccctgagcggcgtcgagggggagggcctccaccgcctgggctacatcctgcgggacgtgtccaagaaggagggcggcgccatgtacgccgacgacaccgccgggtgggacacgcgcatcaccctcgaggacctgaagaacgaggagatggtcaccaaccacatgaagggcgagcacaagaagctggccgaggcgatcttcaagctcacctaccagaacaaggtggtgcgggtccagcgcccgacgccccgcgggaccgtgatggacatcatcagccggcgcgaccagcggggctccggccaggtggggacctacggcctgaacaccttcacgaacatggaggcccagctgatccgccagatggagggggagggcatcttcaagagcatccagcacctcaccgccaccgaggagatcgccgtccagaactggctggcccgggtgggccgcgagcggctgtcccgcatggcgatcagcggggacgactgcgtggtcaagcccctcgacgaccggttcgcctccgccctgaccgccctgaacgacatgggcaaggtgcgcaaggacatccagcagtgggagcccagccgggggtggaacgactggacccaggtgccgttctgctcccaccacttccacgagctcgtcatgaaggacggccgcgtgctggtggtcccctgccggaaccaggacgagctgatcgggcgcgcccggatcagccagggcgcgggctggtccctcaaggagaccgcctgcctgggcaagagctacgcccagatgtggaccctgatgtacttccaccgccgggacctccgcctggccgccaacgcgatctgctccgccgtgcccagccactgggtgcccacctcccggaccacgtggagcatccacgccaagcacgagtggatgaccaccgaggacatgctggccgtctggaaccgcgtgtggatccaggagaacccgtggatggaggacaagacccccgtggagagctgggaggaggtcccctacctcggcaagcgcgaggaccagtggtgcgggtccctgatcggcctgacgagccgggcgacctgggccaagaacatccagaccgccatcaaccaggtgcgctccctcatcgggaacgaggagtacaccgactacatgcccagcatgaagcggttccgccgggaggaggaggaggccggcgtgctgtggtga

SEQ ID NO: 9752 - RNA, 9876 nt, synthetic construct
  misc_feature 1..9876: note = derived and/or modified CDS sequence (opt1) from DENV-2__GQ398284__SS-prME
  source 1..9876: mol_type = other RNA
accgcgggcgtgatcatcatgctgatccccaccgccatggcgttccacctcaccacccggaacggggagccccacatgatcgtgggcaagcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccgccgggagaagcgctccgtcgccctggtgccccacgtggggatgggcctcgagacccggaccgagacctggatgagctccgagggggcctggaagcacgtccagcgcatcgagacgtggatcctgcggcacccgggcttcaccatcatggccgcgatcctggcctacaccatcgggaccacgcacttccagcgcgccctcatcttcatcctgctgaccgccgtggcgcccagcatgaccatgcggtgcatcggcatctccaaccgcgacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcctctgcaagcactccatggtggaccgcggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccgccagtggttcctggacctccccctgccctggctgccgggggccgacacccagggcagcaactggatccagaaggagacgctcgtgaccttcaagaacccccacgcgaagaagcaggacgtggtcgccctggggtcccaggagggcgccatgcacaccgccctgaccggggccacggagatccagatgagcagcggcaacctcctgttcaccggccacctgaagtgccggctccgcatggacaagctgcagctgaaggggatgtcctacagcatgtgcaccggcaagttcaagatcgtgaaggagatcgcggagacccagcacgggacgatcgtcatccgggtgcagtacgagggcgacggctccccctgcaagatccccttcgagatcatggacctcgagaagcgccacgtgctggggcggctgatcaccgtcaacccgatcgtgaccgagaaggacagccccgtgaacatcgaggccgagccgcccttcggcgactcctacatcatcatcggggtcgagccgggccagctcaagctgaactggttcaagaaggggagctccatcggccagatgttcgagaccacgatgcgcggcgccaagcgcatggccatcctgggggacaccgcctgggacttcggcagcctcgggggcgtgttcacctccatcgggaaggcgctgcaccaggtgttcggcgccatctaccgggccgccttcagcggcgtctcctggaccatgaagatcctgatcggggtgatcatcacgtggatcggcatgaacagccgctccaccagcctgtccgtgagcctcgtcctggtgggggtggtcaccctgtacctcggcgcgatggtgcaggccgactccgggtgcgtggtcagctggaagaacaaggagctgaagtgcggctccggcatcttcatcaccgacaacgtgcacacgtggaccgagcagtacaagttccagcccgagagccccagcaagctggcctccgccatccagaaggcccacgaggaggggatctgcggcatccggagcgtgacccgcctcgagaacctgatgtggaagcagatcacccccgagctgaaccacatcctctccgagaacgaggtcaagctgacgatcatgaccggggacatcaagggcatcatgcaggcggggaagcggagcctgcgcccgcagcccaccgagctcaagtactcctggaagacctggggcaaggccaagatgctgagcacggagtcccacaaccagaccttcctgatcgacggccccgagaccgccgagtgcccgaacaccaaccgggcctggaacagcctcgaggtggaggactacgggttcggcgtgttcacgaccaacatctggctgaagctgcgcgagaagcaggacgtcttctgcgactccaagctcatgagcgccgcgatcaaggacaaccgggccgtgcacgccgacatggggtactggatcgagtccgccctgaacgacacctggaagatggagaaggccagcttcatcgaggtgaagtcctgccactggcccaagagccacaccctgtggtccaacggcgtcctcgagagcgagatgatcatccccaagaacttcgcgggccccgtgtcccagcacaactaccgcccggggtaccacacccagacggccggcccctggcacctggggaagctggagatggacttcgacttctgcgagggcaccaccgtggtcgtgaccgaggactgcgggaaccggggccccagcctccgcacgaccaccgccagcggcaagctgatcaccgagtggtgctgccggtcctgcacgctgcccccgctccgctaccgcggggaggacggctgctggtacgggatggagatccgccccctgaaggagaaggaggagaacctggtgaacagcctcgtcaccgccggccacgggcagatcgacaacttctccctgggcgtgctgggcatggccctcttcctggaggagatgctgcggacccgcgtggggaccaagcacgccatcctcctggtcgccgtgagcttcgtgacgctgatcaccggcaacatgtccttccgggacctcgggcgcgtcatggtgatggtgggcgccaccatgaccgacgacatcgggatgggcgtcacgtacctggccctgctcgcggccttcaaggtgcgccccaccttcgccgccggcctgctgctccggaagctgaccagcaaggagctgatgatggccaccatcgggatcgcgctcctgtcccagagcacgatccccgagaccatcctggagctcaccgacgccctggccctgggcatgatggtgctcaagatcgtccgcaacatggagaagtaccagctggccgtgaccatcatggccatctcctgcgtgccgaacgcggtcatcctgcagaacgcctggaaggtgagctgcacgatcctcgccgccgtgtccgtcagccccctgctgctcacctccagccagcagaaggcggactggatccccctggccctgaccatcaaggggctcaaccccaccgccatcttcctgacgaccctgtcccggaccagcaagaagcgctcctggccgctcaacgaggccatcatggccgtgggcatggtcagcatcctggcgtccagcctgctcaagaacgacatccccatgaccggccccctggtggccgggggcctgctcacggtgtgctacgtcctgaccgggcggagcgccgacctggagctcgagcgcgccgccgacgtgaagtgggaggaccaggcggagatctccggcagctcccccatcctgagcatcaccatctccgaggacgggagcatgtccatcaagaacgaggaggaggagcagaccctgacgatcctcatccggaccggcctgctggtgatcagcggcgtcttcccggtgtccatccccatcaccgccgccgcctggtacctctgggaggtgaagaagcagcgcgccggggtcctgtgggacgtgcccagcccgccgcccgtgggcaaggcggagctggaggacggggcctaccggatcaagcagcgcggcatcctcgggtactcccagatcggcgccggcgtctacaaggaggggaccttccacaccatgtggcacgtgacgcggggcgccgtgctgatgcaccgcgggaagcggatcgagcccagctgggccgacgtcaagaaggacctgatctcctacggcgggggctggaagctcgagggcgagtggaaggagggggaggaggtccaggtgctggcgctggagcccggcaagaacccccgcgccgtccagaccaagcccggcctcttcaagaccaacaccggcacgatcggggccgtgagcctggacttctcccccggcaccagcggctcccccatcgtggaccggaaggggaaggtcgtgggcctgtacgggaacggcgtggtcacccgcagcggcgcctacgtgtccgcgatcgcccagaccgagaagtccatcgaggacaaccccgagatcgaggacgacatcttccggaagaagcgcctcacgatcatggacctgcaccccggggccggcaagaccaagcggtacctgcccgccatcgtgcgcgaggccatcaagcgggggctgcgcaccctcatcctggcgccgacccgcgtcgtggccgccgagatggaggaggccctgcggggcctccccatccgctaccagacgcccgccatccgggcggagcacaccgggcgcgagatcgtggacctgatgtgccacgccaccttcaccatgcggctgctcagccccgtccgcgtgccgaactacaacctgatcatcatggacgaggcccacttcacggaccccgcctccatcgccgcgcggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctgcgcaagaacggcaagaaggtcatccagctcagccggaagaccttcgactccgagtacgtgaagacccgcgccaacgactgggacttcgtggtcacgaccgacatcagcgagatgggcgcgaacttcaaggccgagcgggtgatcgacccccgccggtgcatgaagcccgtgatcctgaccgacggggaggagcgcgtcatcctggccggccccatgccggtgacccactccagcgccgcccagcggcgcgggcgcatcggccggaaccccaagaacgagaacgaccagtacatctacatgggggagcccctcgagaacgacgaggactgcgcgcactggaaggaggccaagatgctgctggacaacatcaacacgcccgagggcatcatcccgtccatgttcgagcccgagcgcgagaaggtggacgccatcgacggcgagtaccggctccgcggggaggcccggaagaccttcgtcgacctgatgcgccggggcgacctgcccgtgtggctcgcctaccgcgtggcggccgaggggatcaactacgccgaccggcgctggtgcttcgacggcatcaagaacaaccagatcctggaggagaacgtcgaggtggagatctggaccaaggagggggagcggaagaagctgaagccgcgctggctcgacgcccggatctacagcgaccccctggcgctgaaggagttcaaggagttcgccgccggccgcaagtccctcaccctgaacctgatcacggagatgggccggctccccaccttcatgacccagaaggcccgcgacgccctggacaacctggcggtgctccacaccgccgaggccgggggcaaggcctacaaccacgccctgagcgagctgcccgagacgctcgagaccctgctgctcctgaccctgctcgcgaccgtcaccggcgggatcttcctgttcctgatgtccgggaaggggatcggcaagatgaccctcgggatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgacggtggtcgccgccaccatggccaacgagatgggcttcctcgagaagaccaagaaggacctggggctgggcagcatcatcacccaggagagcgagtccaacatcctcgacatcgacctgcgcccggccagcgcgtggacgctgtacgccgtggccaccaccttcgtgacccccatgctccggcactccatcgagaacagctccgtcaacgtgagcctgacggccatcgcgaaccaggccaccgtgctgatgggcctcgggaagggctggcccctgtccaagatggacatcggggtccccctgctcgccatcggctgctacagccaggtgaacccgatcaccctgaccgccgccctgctcctgctggtggcgcactacgccatcatcgggcccggcctccaggccaaggccacgcgcgaggcccagaagcgggcggccgccggcatcatgaagaaccccaccgtcgacgggatcaccgtgatcgacctggagcccatcccgtacgaccccaagttcgagaagcagctgggccaggtgatgctcctgatcctgtgcgtcacccaggtgctcatgatgcgcacgacctgggccctgtgcgaggccctgaccctcgcgaccgggcccatctccacgctgtgggagggcaaccccgggcgcttctggaacaccaccatcgccgtgagcatggccaacatcttccggggctcctacctggccggcgcggggctcctgttcagcatcatgaagaacaccacgaacacccgccggggcaccgggaacatcggcgagaccctgggcgagaagtggaagtcccgcctcaacgccctgggcaagagcgagttccagatctacaagaagtccggcatccaggaggtcgaccggacgctggccaaggaggggatcaagcgcggcgagaccgaccaccacgccgtgagccgggggtccgccaagctccgctggttcgtggagcggaacatggtcaccccggagggcaaggtggtggacctgggctgcgggcgcggcgggtggagctactactgcggcgggctgaagaacgtccgggaggtgaagggcctcaccaagggcgggcccggccacgaggagcccatccccatgtccacgtacgggtggaacctggtgcgcctgcagagcggcgtcgacgtgttcttcaccccgcccgagaagtgcgacaccctcctgtgcgacatcggggagagctcccccaaccccaccatcgaggcgggccggacgctgcgcgtgctcaacctggtcgagaactggctgaacaacaacacccagttctgcatcaaggtgctcaacccgtacatgcccagcgtgatcgagaagatggagaccctgcagcggaagtacggcggggccctggtccgcaaccccctgtcccggaacagcacccacgagatgtactgggtgtccaacgccaccggcaacatcgtgagctccgtcaacatgatcagccgcatgctcatcaaccggttcacgatgaagcacaagaaggccacctacgagccggacgtggacctggggtccggcacccgcaacatcgggatcgagagcgagatccccaacctggacatcatcggcaagcgcatcgagaagatcaagcaggagcacgagacctcctggcactacgaccaggaccacccctacaagacgtgggcctaccacggcagctacgagaccaagcagaccgggtccgcgagctccatggtgaacggcgtcgtgcggctcctgaccaagccctgggacgtggtcccgatggtgacgcagatggccatgaccgacaccacccccttcgggcagcagcgcgtgttcaaggagaaggtcgacacgcggacccaggagcccaaggagggcaccaagaagctgatgaagatcaccgccgagtggctctggaaggagctgggcaagaagaagacgccccgcatgtgcacccgggaggagttcacccgcaaggtgcggagcaacgccgccctgggggcgatcttcaccgacgagaacaagtggaagtccgcccgcgaggccgtggaggacagccggttctgggagctcgtcgaccgcgagcggaacctgcacctggagggcaagtgcgagacgtgcgtgtacaacatgatggggaagcgcgagaagaagctcggcgagttcgggaaggccaagggctcccgggcgatctggtacatgtggctgggcgcccgcttcctggagttcgaggccctcgggttcctgaacgaggaccactggttcagccggggcaacagcctgtccggggtggagggcgaggggctccaccgcctgggctacatcctgcgggacgtcagcaagaaggagggcggggccatgtacgccgacgacaccgcgggctgggacacccgcatcaccctcgaggacctgaagaacgaggagatggtgacgaaccacatgaagggggagcacaagaagctggccgaggccatcttcaagctcacctaccagaacaaggtcgtgcgggtgcagcgcccgacgccccggggcaccgtcatggacatcatctcccgccgcgaccagcgggggagcggccaggtgggcacgtacgggctgaacaccttcaccaacatggaggcccagctgatccgccagatggagggcgaggggatcttcaagtccatccagcacctcaccgtgacggaggagatcgccgtccagaactggctggcgcgggtgggccgcgagcggctgagccgcatggccatctccggcgacgactgcgtggtcaagcccctcgacgaccggttcgccagcgccctgaccgccctgaacgacatggggaaggtgcgcaaggacatccagcagtgggagccctcccggggctggaacgactggacccaggtgccgttctgcagccaccacttccacgagctcgtcatgaaggacgggcgcgtgctggtggtcccctgccggaaccaggacgagctgatcggccgcgcgcggatctcccagggggccggctggagcctcaaggagaccgcctgcctgggcaagtcctacgcccagatgtggacgctgatgtacttccaccgccgggacctccgcctggccgcgaacgccatctgcagcgccgtgccctcccactgggtgcccaccagccggaccacctggtccatccacgccaaccacgagtggatgaccacggaggacatgctggcggtctggaaccgcgtgtggatccaggagaacccgtggatggaggacaagacccccgtggagagctgggaggaggtcccctacctcgggaagcgggaggaccagtggtgcggcagcctgatcgggctgacctcccgcgccacctgggccaagaacatccagacggccatcaaccaggtgcgcagcctcatcggcaacgaggagtacaccgactacatgccctccatgaagcggttccgccgggaggaggaggaggccggggtgctgtggtga

SEQ ID NO: 9753 - RNA, 9876 nt, synthetic construct
  misc_feature 1..9876: note = derived and/or modified CDS sequence (opt1) from DENV-2__GQ398308__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaactccaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcagcaccaacatctggctgaagctgcgcgagaagcaggacgtgttctgcgactccaagctcatgagcgccgcgatcaaggacaaccgggccgtccacgccgacatgggctactggatcgagtccgccctgaacgacacgtggaagatggagaaggccagcttcatcgaggtgaagtcctgccactggcccaagagccacaccctgtggtccaacggcgtgctcgagagcgagatgatcatccccaagaacttcgcggggcccgtcagccagcacaactaccgcccgggctaccacacccagaccgccgggccctggcacctgggcaagctggagatggacttcgacttctgcgaggggaccacggtggtggtcaccgaggactgcggcaaccggggcccctccctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacgcgcgtgggcaccaagcacgccatgctcctggtggccgtcagcttcgtgaccctgatcaccgggaacatgtccttccgggacctcggccgcgtgatggtcatggtgggggccacgatgaccgacgacatcggcatgggcatcacctacctggccctgctcgcggccttcaaggtgcgccccaccttcgccgccgggctgctgctccggaagctgacgagcaaggagctgatgatggccaccatcggcatcgcgctcctgtcccagagcaccatccccgagaccatcctggagctcacggacgccctggccctggggatgatggtcctcaagatcgtgcgcaacatggagaagtaccagctggccgtgaccatcatggccatctcctgcgtcccgaacgcggtgatcctgcagaacgcctggaaggtgagctgcaccatcctcgccgccgtctccgtgagccccctgctgctcacctccagccagcagaaggcggactggatccccctggccctgacgatcaagggcctcaaccccaccgccatcttcctgaccaccctgtcccggacgagcaagaagcgctcctggccgctcaacgaggccatcatggccgtcggcatggtgagcatcctggcgagctccctgctcaagaacgacatccccatgaccgggcccctggtggccggcgggctgctcaccgtctgctacgtgctgaccggccggagcgccgacctggagctcgagcgcgccgccgacgtgaagtgggaggaccaggcggagatctccgggagctcccccatcctgagcatcacgatctccgaggacggcagcatgtccatcaagaacgaggaggaggagcagaccctgaccatcctcatccggaccggcctgctggtcatcagcggggtgttcccggtgtccatccccatcacggccgccgcctggtacctctgggaggtcaagaagcagcgcgccggcgtgctgtgggacgtgcccagcccgccgcccgtcgggaaggcggagctggaggacggcgcctaccggatcaagcagcgcgggatcctcggctactcccagatcggcgccggggtgtacaaggagggcaccttccacaccatgtggcacgtgacccgcggggcggtcctgatgcaccgcggcaagcggatcgagcccagctgggccgacgtgaagaaggacctgatctcctacgggggcggctggaagctcgagggggagtggaaggagggcgaggaggtgcaggtcctggcgctggagcccgggaagaacccccgcgccgtgcagaccaagcccggcctcttcaagacgaacaccgggaccatcggcgccgtgagcctggacttctcccccggcaccagcgggtcccccatcgtcgaccggaagggcaaggtggtggggctgtacggcaacggcgtcgtgacgcgcagcggggcctacgtgagcgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtccgcgaggccatcaagcggggcctgcgcacgctcatcctggcgccgacccgcgtggtggccgccgagatggaggaggccctgcgggggctccccatccgctaccagacccccgccatccgggcggagcacaccggccgcgagatcgtcgacctgatgtgccacgccacgttcaccatgcggctgctcagccccgtgcgcgtgccgaactacaacctgatcatcatggacgaggcccacttcaccgaccccgcctccatcgccgcgcggggctacatcagcacccgcgtcgagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtgtggttcgtcccgtccatcaaggccggcaacgacatcgccgcctgcctgcgcaagaacggcaagaaggtgatccagctcagccggaagacgttcgactccgagtacgtgaagacccgcgccaacgactgggacttcgtcgtgaccaccgacatcagcgagatgggggcgaacttcaaggccgagcgggtgatcgacccccgccggtgcatgaagcccgtcatcctgacggacggcgaggagcgcgtgatcctggccgggcccatgccggtgacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtcgacgccatcgacggggagtaccggctccgcggcgaggcccggaagaccttcgtggacctgatgcgccgcggggacctgcccgtgtggctcgcctaccgcgtcgcggccgagggcatcaactacgccgaccggcgctggtgcttcgacgggatcaagaacaaccagatcctggaggagaacgtggaggtggagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcgacgccctggacaacctggcggtcctccacaccgccgaggccggcgggcgggcctacaaccacgccctgagcgagctgcccgagaccctcgagaccctgctgctcctgacgctgctcgcgaccgtgaccggcggcatcttcctgttcctgatgtccgggaagggcatcgggaagatgaccctcggcatgtgctgcatcatcacggccagcatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccaccatggccaacgagatggggttcctcgagaagacgaagaaggacctgggcctgggctccatcgccacccaggagagcgagtccaacatcctcgacatcgacctgcggccggcgagcgcctggaccctgtacgccgtggccaccacgttcgtcacccccatgctccgccactccatcgagaacagctccgtgaacgtgagcctgaccgcgatcgccaaccaggccaccgtcctgatggggctcggcaaggggtggcccctgtccaagatggacatcggcgtgcccctgctcgccatcgggtgctacagccaggtgaacccgatcacgctgaccgccgcgctgctcctgctggtcgcccactacgccatcatcggccccggcctccaggccaaggccacccgggaggcgcagaagcgcgccgccgccgggatcatgaagaaccccaccgtggacggcatcacggtgatcgacctggagcccatcccgtacgaccccaagttcgagaagcagctggggcaggtcatgctcctgatcctgtgcgtgacccaggtgctcatgatgcgcaccacctgggccctgtgcgaggcgctgacgctcgccaccggccccatctccaccctgtgggaggggaaccccggccggttctggaacaccacgatcgccgtcagcatggccaacatcttccgcggctcctacctggcgggggccggcctcctgttcagcatcatgaagaacaccaccaacacccggcgcgggacgggcaacatcggcgagaccctgggggagaagtggaagtcccggctcaacgccctgggcaagagcgagttccagatctacaagaagtccgggatccaggaggtggaccgcaccctggccaaggagggcatcaagcgcggggagaccgaccaccacgccgtgagccgcggctccgcgaagctccggtggttcgtcgagcgcaacatggtgacgccggagggcaaggtggtcgacctggggtgcggccgcggcgggtggagctactactgcggcgggctgaagaacgtgcgcgaggtgaaggggctcaccaagggcgggcccgggcacgaggagcccatccccatgagcacctacggctggaacctggtccggctgcagtccggggtggacgtgttcttcaccccgcccgagaagtgcgacacgctcctgtgcgacatcggcgagagctcccccaaccccaccatcgaggccggccgcaccctgcgggtcctcaacctggtggagaactggctgaacaacgacacccagttctgcatcaaggtgctcaacccgtacatgcccagcgtcatcgagaagatggagacgctgcagcgcaagtacgggggcgccatcgtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacctacgagccggacgtggacctcggctccgggacgcgcaacatcggcatcgagagcgagatccccaacctggacatcatcggcaagcggatcgagaagatcaagcaggagcacgagacctcctggcactacgaccaggaccacccctacaagacctgggcgtaccacgggagctacgagaccaagcagacgggctccgccagctccatggtcaacggggtggtgcgcctgctcaccaagccctgggacgtcgtgccgatggtgacccagatggccatgaccgacacgacccccttcggccagcagcgggtcttcaaggagaaggtggacacccgcacccaggagcccaaggagggcacgaagaagctgatgaagatcaccgccgagtggctgtggaaggagctcgggaagaagaagacgccccggatgtgcacccgcgaggagttcacgcggaaggtgcgcagcaacgccgcgctgggcgccatcttcaccgacgagaacaagtggaagtccgcccgggaggccgtcgaggacagccgcttctgggagctgatcgaccgggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgggaacagcctgtccggcgtggagggggagggcctgcaccggctcggctacatcctgcgcgacgtcagcaagaaggagggcggcgccatgtacgcggacgacaccgccgggtgggacacgcggatcaccctggaggacctcaagaacgaggagatggtgaccaaccacatgaagggcgagcacaagaagctggccgaggccatcttcaagctgacctaccagaacaaggtcgtgcgcgtgcagcggccgacgccccgcgggaccgtcatggacatcatctcccgccgggaccagcgcggcagcggccaggtggggacctacggcctcaacaccttcacgaacatggaggcccagctgatccggcagatggagggggagggcatcttcaagtccatccagcacctgaccgtgaccgaggagatcgcggtccagaactggctcgcccgcgtgggccgggagcgcctgagccggatggccatctccggggacgactgcgtggtcaagcccctggacgaccgcttcgccagcgccctcaccgcgctgaacgacatgggcaaggtgcggaaggacatccagcagtgggagccctcccgcgggtggaacgactggacccaggtcccgttctgcagccaccacttccacgagctggtcatgaaggacggccgggtgctcgtggtcccctgccgcaaccaggacgagctgatcgggcgggcccgcatctcccagggcgccggctggagcctgaaggagaccgcctgcctcgggaagtcctacgcccagatgtggaccctgatgtacttccaccggcgcgacctgcggctcgcggccaacgccatctgcagcgccgtgccctcccactgggtgcccaccagccgcacgacctggagcatccacgcgaagcacgagtggatgaccaccgaggacatgctgaccgtctggaaccgggtgtggatccaggagaacccgtggatggaggacaagacgcccgtggagtcctgggaggaggtcccctacctgggcaagcgcgaggaccagtggtgcgggagcctcatcggcctgacctcccgcgccacctgggccaagaacatccagaccgccatcaaccaggtgcggagcctgatcgggaacgaggagtacacggactacatgccctccatgaagcgcttccggcgcgaggaggaggaggccggcgtgctctggtga

SEQ ID NO: 9754 - RNA, 9876 nt, synthetic construct
  misc_feature 1..9876: note = derived and/or modified CDS sequence (opt1) from DENV-2__GQ398287__SS-prME
  source 1..9876: mol_type = other RNA
accgccggggtgatcatcatgctgatccccaccgccatggcgttccacctcaccacccgcaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcgtgtgcaagcactccatggtggaccggggctgggggaacggctgcggcctgttcggcaagggcgggatcgtcacgtgcgccatgttcacgtgcaagaagaacatggagggcaaggtggtgctgcccgagaacctggagtacaccatcgtcatcacgccccacagcggggaggagcacgccgtgggcaacgacacggggaagcacggcaaggagatcaagatcaccccgcagtccagcatcaccgaggccgagctcaccgggtacggcaccgtgacgatggagtgcagcccccgcaccggcctggacttcaacgagatggtcctgctccagatggaggacaaggcctggctggtgcaccggcagtggttcctggacctccccctgccctggctgccgggggcggacacccagggcagcaactggatccagaaggagaccctcgtgacgttcaagaacccccacgccaagaagcaggacgtcgtggtcctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtgaaggagatcgcggagacccagcacgggaccatcgtgatccgcgtccagtacgagggcgacggctccccctgcaagatccccttcgagatcatggacctcgagaagcggcacgtgctggggcgcctgatcacggtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacctggcggggcccgtgagccagcacaactaccgcccgggctaccacacccagaccgccgggccctggcacctgggcaagctcgagatggacttcgacttctgcgaggggacgaccgtggtggtcaccgaggactgcggcaaccggggccccagcctgcgcaccacgaccgcctccgggaagctgatcaccgagtggtgctgccggagctgcaccctcccgcccctgcgctaccggggcgaggacgggtgctggtacggcatggagatccgccccctgaaggagaaggaggagaacctcgtgaactccctggtgacggccgggcacggccagatcgacaacttcagcctgggcgtcctcgggatggcgctgttcctggaggagatgctccggacccgcgtgggcaccaagcacgccatcctgctgatcgccgtgtccttcgtcaccctcatcacggggaacatgagcttccgggacctgggccgcgtgatggtgatggtcggggccaccatgaccgacgacatcggcatgggcgtgacctacctggccctcctggcggccttcaaggtgcgccccacgttcgccgccgggctgctcctgcggaagctgacctccaaggagctcatgatggccaccatcggcatcgcgctgctgagccagtccaccatccccgagacgatcctcgagctgaccgacgccctggccctcgggatgatggtcctgaagatcgtgcgcaacatggagaagtaccagctggccgtgaccatcatggccatcagctgcgtccccaacgcggtgatcctccagaacgcctggaaggtgtcctgcaccatcctggccgccgtcagcgtgagccccctgctcctgacgagctcccagcagaaggcggactggatccccctggccctcaccatcaagggcctgaaccccaccgccatcttcctgaccacgctcagccggacctccaagaagcgcagctggccgctgaacgaggccatcatggccgtcggcatggtgtccatcctggcgagcagcctcctgaagaacgacatccccatgaccgggcccctggtggccggcgggctcctgaccgtctgctacgtgctgacgggccggtccgccgacctcgagctggagcgcgccgccgacgtgaagtgggaggaccaggcggagatcagcgggtccagccccatcctgtccatcaccatcagcgaggacggctccatgagcatcaagaacgaggaggaggagcagaccctcaccatcctgatccggacgggcctgctcgtcatctccggggtgttcccggtgagcatccccatcaccgccgccgcctggtacctgtgggaggtcaagaagcagcgcgccggcgtgctgtgggacgtgcccagcccgccgcccgtcgagaaggcggagctcgaggacggggcctaccggatcaagcagcgcggcatcctggggtacagccagatcggcgccggcgtgtacaaggaggggaccttccacaccatgtggcacgtgacccggggcgccgtcctgatgcaccgcgggaagcggatcgagccctcctgggccgacgtgaagaaggacctcatcagctacggcgggggctggaagctggagggcgagtggaaggagggggaggaggtgcaggtcctggcgctcgagcccggcaagaacccccgcgccgtgcagacgaagcccgggctgttcaagaccaacaccggcaccatcggggccgtgtccctggacttcagccccggcacgtccggcagccccatcgtcgaccggaaggggaaggtggtgggcctctacgggaacggcgtcgtgacccgctccggcgcctacgtgagcgcgatcgcccagaccgagaagtccatcgaggacaaccccgagatcgaggacgacatcttccggaagaagcgcctgaccatcatggacctgcaccccggggccggcaagacgaagcggtacctgcccgccatcgtccgcgaggccatcaagcgggggctccgcaccctgatcctggcgccgacccgcgtggtggccgccgagatggaggaggccctccggggcctgcccatccgctaccagacccccgccatccgggcggagcacacggggcgcgagatcgtcgacctgatgtgccacgccaccttcaccatgcggctcctgtcccccgtgcgcgtgccgaactacaacctgatcatcatggacgaggcccacttcaccgaccccgccagcatcgccgcgcggggctacatctccacgcgcgtcgagatgggcgaggccgccgggatcttcatgaccgccacgccgcccggcagccgggacccgttcccccagtccaacgcgcccatcatggacgaggagcgcgagatccccgagcggagctggaactccgggcacgagtgggtgaccgacttcaagggcaagacggtgtggttcgtcccgagcatcaaggccgggaacgacatcgccgcctgcctccgcaagaacggcaagaaggtgatccagctgtcccggaagaccttcgacagcgagtacgtgaagacccgcgccaacgactgggacttcgtcgtgaccacggacatctccgagatgggcgcgaacttcaaggccgagcgggtgatcgacccccgccggtgcatgaagcccgtcatcctgaccgacggggaggagcgcgtgatcctcgccggccccatgccggtgacccacagctccgccgcccagcggcgcgggcgcatcggccggaaccccaagaacgagaacgaccagtacatctacatgggggagcccctggagaacgacgaggactgcgcgcactggaaggaggccaagatgctgctcgacaacatcaacacccccgagggcatcatcccgagcctgttcgagcccgagcgcgagaaggtcgacgccatcgacggcgagtaccggctgcgcggggaggcccggaagacgttcgtggacctcatgcgccggggcgacctgcccgtgtggctggcctaccgcgtcgcggccgaggggatcaactacgccgaccggcgctggtgcttcgacggcatcaagaacaaccagatcctcgaggagaacgtggaggtggagatctggaccaaggagggggagcggaagaagctgaagccgcgctggctggacgcccggatctactccgaccccctcgcgctgaaggagttcaaggagttcgccgccggccgcaagagcctgaccctcaacctgatcaccgagatgggccggctgcccacgttcatgacccagaaggcccgcgacgccctcgacaacctggcggtcctgcacaccgccgaggccgggggccgggcctacaaccacgccctctccgagctgcccgagaccctggagacgctcctgctgctcaccctgctggcgaccgtgaccgggggcatcttcctcttcctgatgagcggccgcgggatcggcaagatgacgctggggatgtgctgcatcatcaccgcctccatcctcctgtggtacgcccagatccagccgcactggatcgccgccagcatcatcctggagttcttcctcatcgtcctgctgatccccgagcccgagaagcagcggacgccccaggacaaccagctcacctacgtggtgatcgcgatcctgaccgtcgtggccgccacgatggccaacgagatgggcttcctggagaagaccaagaaggacctcgggctgggcagcatcaccacccaggagtccgagagcaacatcctggacatcgacctccgcccggcctccgcgtggacgctgtacgccgtggccaccaccttcgtcacccccatgctgcggcacagcatcgagaactccagcgtgaacgtgtccctcacggccatcgcgaaccaggccaccgtcctgatgggcctggggaagggctggcccctcagcaagatggacatcggggtgcccctgctggccatcggctgctactcccaggtgaacccgatcaccctcaccgccgccctgctgctcctggtcgcgcactacgccatcatcgggcccggcctgcaggccaaggccacgcgcgaggcccagaagcgcgcggccgccggcatcatgaagaaccccaccgtggacgggatcaccgtgatcgacctcgagcccatcccgtacgaccccaagttcgagaagcagctgggccaggtcatgctgctcatcctgtgcgtgacccaggtgctgatgatgcggacgacctgggccctctgcgaggccctgaccctggcgaccgggcccatcagcacgctctgggagggcaaccccgggcgcttctggaacaccaccatcgccgtctccatggccaacatcttccggggcagctacctggccggcgcggggctcctcttctccatcatgaagaacaccacgaacacccgccggggcaccgggaacatcggcgagaccctgggcgagaagtggaagtcccgcctgaacgccctcggcaagagcgagttccagatctacaagaagtccgggatccaggaggtggaccggacgctggccaaggaggggatcaagcgcggcgagaccgaccaccacgccgtgtcccgggggagcgccaagctgcgctggttcgtcgagcggaacatggtgaccccggagggcaaggtggtcgacctcggctgcgggcgcggcgggtggtcctactactgcggcgggctgaagaacgtgcgggaggtgaagggcctgaccaagggcgggcccggccacgaggagcccatccccatgagcacgtacgggtggaacctcgtccgcctgcagagcggcgtggacgtgttcttcaccccgcccgagaagtgcgacaccgtcctgtgcgacatcggggagtccagccccaaccccaccatcgaggcgggccggacgctccgcgtgctgaacctggtggagaactggctcaacaacaacacccagttctgcatcaaggtcctgaacccgtacatgccctccgtgatcgagaagatggagaccctgcagcggaagtacggcggggccctggtgcgcaaccccctcagccggaactccacccacgagatgtactgggtcagcaacgccaccggcaacatcgtgtccagcgtgaacatgatctcccgcatgctgatcaaccgcttcacgatgaagcacaagaaggccacctacgagccggacgtcgacctggggagcggcacccggaacatcgggatcgagtccgagatccccaacctcgacatcatcggcaagcgcatcgagaagatcaagcaggagcacgagaccagctggcactacgaccaggaccacccctacaagacgtgggcctaccacggctcctacgagaccaagcagaccgggagcgcgtccagcatggtgaacggcgtggtccggctgctgaccaagccctgggacgtggtgccgatggtcacgcagatggccatgaccgacaccacccccttcgggcagcagcgcgtgttcaaggagaaggtggacacgcggacccaggagcccaaggagggcaccaagaagctcatgaagatcaccgccgagtggctgtggaaggagctgggcaagaagaagacgccccgcatgtgcacccgggaggagttcacccgcaaggtccggtccaacgccgccctcggggcgatcttcaccgacgagaacaagtggaagtccgcccgcgaggccgtggaggactcccggttctgggagctgatcgaccgcgagcggaacctgcacctcgagggcaagtgcgagacgtgcgtgtacaacatgatggggaagcgcgagaagaagctgggcgagttcgggaaggccaagggcagccgggcgatctggtacatgtggctgggcgcccgcttcctcgagttcgaggccctggggttcctgaacgaggaccactggttcagccggcgcaactccctcagcggcgtcgagggggagggcctgcaccggctggggtacatcctccgcgacgtgtccaagaaggagggcggcgccatgtacgccgacgacaccgcggggtgggacacccggatcaccctggaggacctgaagaacgaggagatggtcacgaaccacatgaagggcgagcacaagaagctcgccgaggccatcttcaagctgacctaccagaacaaggtggtgcgcgtccagcgcccgacgccccgggggaccgtgatggacatcatcagccgccgggaccagcgcggctccggccaggtgggcacctacggcctgaacaccttcaccaacatggaggcccagctcatccggcagatggagggggagggcatcttcaagagcatccagcacctgaccgtcacggaggagatcgccgtgcagaactggctggcgcgcgtggggcgggagcgcctctcccggatggccatcagcggcgacgactgcgtcgtgaagcccctggacgaccgcttcgcctccgccctgaccgccctcaacgacatgggcaaggtgcggaaggacatccagcagtgggagcccagccgcgggtggaacgactggacccaggtcccgttctgctcccaccacttccacgagctggtgatgaaggacggccgggtgctggtcgtgccctgccgcaaccaggacgagctcatcgggcgggcgcgcatcagccagggcgccgggtggtccctgaaggagaccgcctgcctgggcaagagctacgcccagatgtggacgctcatgtacttccaccggcgcgacctgcggctggccgcgaacgccatctgctccgccgtgcccagccactgggtccccacctcccgcaccacctggagcatccacgccaagcacgagtggatgaccacggaggacatgctcgcggtgtggaaccgcgtgtggatccaggagaacccgtggatggaggacaagacccccgtcgagagctgggaggaggtgccctacctgggcaagcgggaggaccagtggtgcgggtccctgatcggcctcaccagccgcgccacctgggccaagaacatccagacggccatcaaccaggtgcggtccctgatcgggaacgaggagtacaccgactacatgcccagcatgaagcgcttccggcgcgaggaggaggaggccggcgtcctgtggtga

SEQ ID NO: 9755 - RNA, 9876 nt, synthetic construct
  misc_feature 1..9876: note = derived and/or modified CDS sequence (opt1) from DENV-2__GQ398302__SS-prME
  source 1..9876: mol_type = other RNA
accgcgggggtcatcatcatgctgatccccaccgccatggcgttccacctcaccacccgcaacggggagccccacatgatcgtcagccggcaggagaagggcaagagcctgctgttcaagaccgaggacggggtgaacatgtgcaccctcatggccatcgacctgggggagctgtgcgaggacaccatcacctacaagtgccccctcctgcgccagaacgagcccgaggacatcgactgctggtgcaacagcacctccacctgggtgacctacgggacctgcaccaccaccggcgagcaccggcgcgagaagcggagcgtcgccctggtgccccacgtgggcatggggctcgagacccgcaccgagacctggatgtccagcgagggcgcctggaagcacgtccagcggatcgagacctggatcctgcgccacccggggttcaccatcatggccgcgatcctggcctacaccatcggcaccacgcacttccagcgggccctcatcttcatcctgctgaccgccgtggcgccctccatgaccatgcgctgcatcgggatcagcaaccgggacttcgtggagggcgtctccggcgggagctgggtggacatcgtgctcgagcacggctcctgcgtcaccacgatggccaagaacaagcccaccctggacttcgagctgatcaagaccgaggccaagcagcccgccaccctccgcaagtactgcatcgaggccaagctgacgaacaccaccaccgagagccggtgcccgacgcagggggagccctccctgaacgaggagcaggacaagcgcttcgtgtgcaagcacagcatggtggaccggggctggggcaacgggtgcggcctcttcgggaagggcgggatcgtgacctgcgcgatgttcacgtgcaagaagaacatggagggcaaggtggtgctgcccgagaacctggagtacaccatcgtcatcacgccccactccggcgaggagcacgccgtggggaacgacaccggcaagcacgggaaggagatcaagatcaccccgcagagctccatcaccgaggccgagctcaccggctacgggacggtgaccatggagtgcagcccccgcaccggcctggacttcaacgagatggtcctgctccagatggaggacaaggcctggctggtgcaccggcagtggttcctggacctccccctgccctggctgccgggcgccgacacccaggggtccaactggatccagaaggagacgctcgtgaccttcaagaacccccacgcgaagaagcaggacgtcgtggtcctgggcagccaggagggggccatgcacaccgccctgaccggcgccacggagatccagatgagctccgggaacctcctgttcaccggccacctgaagtgccgcctccggatggacaagctgcagctgaagggcatgagctactccatgtgcaccgggaagttcaagatcgtgaaggagatcgccgagacccagcacggcacgatcgtgatccgcgtccagtacgagggggacggcagcccctgcaagatccccttcgagatcatggacctcgagaagcggcacgtgctgggccgcctgatcaccgtgaacccgatcgtcgcggagaaggactcccccgtgaacatcgaggccgagccgcccttcggggacagctacatcatcatcggcgtggagccggggcagctcaagctgaactggttcaagaagggctccagcatcgggcagatgttcgagaccaccatgcgcggcgccaagcggatggccatcctgggcgacacggcctgggacttcgggtccctcggcggggtcttcaccagcatcggcaaggcgctgcaccaggtgttcggggccatctacggcgccgccttctccggcgtgagctggaccatgaagatcctgatcggggtcatcatcacctggatcggcatgaactcccgcagcacgtccctgagcgtgtccctcgtgctggtcggggtggtgaccctgtacctcggcgcgatggtccaggccgacagcgggtgcgtggtgtcctggaagtccaaggagctgaagtgcggcagcggcatcttcatcaccgacaacgtccacacctggacggagcagtacaagttccagcccgagtcccccagcaagctggcctccgccatccagaaggcccacgaggaggggatctgcggcatccggagcgtgacccgcctcgagaacctgatgtggaagcagatcacccccgagctgaaccacatcctctccgagaacgaggtgaagctgaccatcatgacgggggacatcaagggcatcatgcaggcggggaagcggagcctgcgcccgcagcccaccgagctcaagtactcctggaagacctggggcaaggccaagatgctgagcaccgagtcccacaaccagacgttcctgatcgacggccccgagaccgccgagtgcccgaacaccaaccgggcctggaacagcctcgaggtcgaggactacgggttcggcgtgttcaccacgaacatctggctgaagctgcgcgagaagcaggacgtgttctgcgactccaagctcatgagcgccgcgatcaaggacaaccgggccgtccacgccgacatggggtactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgcgggccccgtcagccagcacaactaccgcccggggtaccacacccagaccgccggcccctggcacctggggaagctggagatggacttcgacttctgcgagggcacgaccgtggtggtcaccgaggactgcgggaaccggggcccctccctccgcaccacgaccgccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtgacggccggccacgggcagatcgacaacttctccctgggcgtcctgggcatggccctcttcctggaggagatgctgcggacccgcgtggggaccaagcacgccatgctcctggtggccgtcagcttcgtgaccctgatcacgggcaacatgtccttccgggacctcgggcgcgtgatggtcatggtgggcgccaccatgaccgacgacatcgggatgggcatcacctacctggccctgctcgcggccttcaaggtgcgccccacgttcgccgccggcctgctgctccggaagctgaccagcaaggagctgatgatggccaccatcgggatcgcgctcctgtcccagagcaccatccccgagacgatcctggagctcaccgacgccctggccctgggcatgatggtcctcaagatcgtgcgcaacatggagaagtaccagctggccgtgaccatcatggccatctcctgcgtcccgaacgcggtgatcctgcagaacgcctggaaggtgagctgcaccatcctcgccgccgtctccgtgagccccctgctgctcacgtccagccagcagaaggcggactggatccccctggccctgaccatcaaggggctcaaccccaccgccatcttcctgaccacgctgtcccggaccagcaagaagcgctcctggccgctcaacgaggccatcatggccgtcggcatggtgagcatcctggcgagctccctgctcaagaacgacatccccatgaccggccccctggtggccgggggcctgctcaccgtctgctacgtgctgacggggcggagcgccgacctggagctcgagcgcgccgccgacgtgaagtgggaggaccaggcggagatctccggcagctcccccatcctgagcatcaccatctccgaggacgggagcatgtccatcaagaacgaggaggaggagcagaccctgaccatcctcatccggacgggcctgctggtcatcagcggcgtgttcccggtgtccatccccatcaccgccgccgcctggtacctctgggaggtcaagaagcagcgcgccggggtgctgtgggacgtgcccagcccgccgcccgtcggcaaggcggagctggaggacggggcctaccggatcaagcagcgcggcatcctcgggtactcccagatcggcgccggcgtgtacaaggaggggaccttccacaccatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagacgaagcccggcctcttcaagaccaacaccggcaccatcggggccgtgagcctggacttctcccccggcacgagcggctcccccatcgtcgaccggaaggggaaggtggtgggcctgtacgggaacggcgtcgtgacccgcagcggcgcctacgtgagcgcgatcgcccagaccgagaagtccatcgaggacaaccccgagatcgaggacgacatcttccggaagaagcgcctcaccatcatggacctgcaccccggggccggcaagacgaagcggtacctgcccgccatcgtccgcgaggccatcaagcgggggctgcgcaccctcatcctggcgccgacccgcgtggtggccgccgagatggaggaggccctgcggggcctccccatccgctaccagacccccgccatccgggcggagcacacggggcgcgagatcgtcgacctgatgtgccacgccaccttcaccatgcggctgctcagccccgtgcgcgtgccgaactacaacctgatcatcatggacgaggcccacttcaccgaccccgcctccatcgccgcgcggggctacatcagcacgcgcgtcgagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtgaccgacttcaagggcaagacggtgtggttcgtcccgtccatcaaggccgggaacgacatcgccgcctgcctgcgcaagaacggcaagaaggtgatccagctcagccggaagaccttcgactccgagtacgtgaagacccgcgccaacgactgggacttcgtcgtgaccacggacatcagcgagatgggcgcgaacttcaaggccgagcgggtgatcgacccccgccggtgcatgaagcccgtcatcctgaccgacggggaggagcgcgtgatcctggccggccccatgccggtgacccactccagcgccgcccagcggcgcgggcgcatcggccggaaccccaagaacgagaacgaccagtacatctacatgggggagcccctcgagaacgacgaggactgcgcgcactggaaggaggccaagatgctgctggacaacatcaacacccccgagggcatcatcccgtccatgttcgagcccgagcgcgagaaggtcgacgccatcgacggcgagtaccggctccgcggggaggcccggaagacgttcgtggacctgatgcgccggggcgacctgcccgtgtggctcgcctaccgcgtcgcggccgaggggatcaactacgccgaccggcgctggtgcttcgacggcatcaagaacaaccagatcctggaggagaacgtggaggtggagatctggaccaaggagggggagcggaagaagctgaagccgcgctggctcgacgcccggatctacagcgaccccctggcgctgaaggagttcaaggagttcgccgccggccgcaagtccctcaccctgaacctgatcaccgagatgggccggctccccacgttcatgacccagaaggcccgcgacgccctggacaacctggcggtcctccacaccgccgaggccgggggccgggcctacaaccacgccctgagcgagctgcccgagaccctcgagacgctgctgctcctgaccctgctcgcgaccgtgaccgggggcatcttcctgttcctgatgtccggcaaggggatcggcaagatgacgctcgggatgtgctgcatcatcaccgccagcatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccacgatggccaacgagatgggcttcctcgagaagaccaagaaggacctggggctgggctccatcgccacccaggagagcgagtccaacatcctcgacatcgacctgcggccggcgagcgcctggaccctgtacgccgtggccacgaccttcgtcacccccatgctccgccactccatcgagaacagctccgtgaacgtgagcctgaccgcgatcgccaaccaggccacggtcctgatgggcctcgggaagggctggcccctgtccaagatggacatcggggtgcccctgctcgccatcggctgctacagccaggtgaacccgatcaccctgaccgccgcgctgctcctgctggtcgcccactacgccatcatcgggcccggcctccaggccaaggccacccgggaggcgcagaagcgcgccgccgccggcatcatgaagaaccccacggtggacgggatcaccgtgatcgacctggagcccatcccgtacgaccccaagttcgagaagcagctgggccaggtcatgctcctgatcctgtgcgtgacccaggtgctcatgatgcgcaccacgtgggccctgtgcgaggcgctgaccctcgccaccgggcccatctccaccctgtgggagggcaaccccgggcggttctggaacacgaccatcgccgtcagcatggccaacatcttccgcggctcctacctggcgggcgccgggctcctgttcagcatcatgaagaacaccaccaacacgcggcgcggcaccgggaacatcggcgagaccctgggcgagaagtggaagtcccggctcaacgccctgggcaagagcgagttccagatctacaagaagtccggcatccaggaggtggaccgcaccctggccaaggaggggatcaagcggggcgagacggaccaccacgccgtgagccgcgggtccgcgaagctccggtggttcgtcgagcgcaacatggtgaccccggagggcaaggtggtcgacctgggctgcgggcggggcgggtggagctactactgcggcgggctgaagaacgtgcgcgaggtgaagggcctcaccaagggcgggcccggccacgaggagcccatccccatgagcacctacgggtggaacctggtccggctgcagtccggcgtggacgtgttcttcacgccgcccgagaagtgcgacaccctcctgtgcgacatcggggagagctcccccaaccccaccatcgaggccggccgcaccctgcgggtcctcaacctggtggagaactggctgaacaacaacacgcagttctgcatcaaggtgctcaacccgtacatgcccagcgtcatcgagaagatggagaccctgcagcgcaagtacggcggggccctggtgcggaaccccctgtcccgcaacagcacccacgagatgtactgggtgtccaacgccaccggcaacatcgtcagctccgtgaacatgatcagccggatgctcatcaaccgcttcaccatgaagcacaagaaggccacgtacgagccggacgtggacctggggtccggcacccgcaacatcgggatcgagagcgagatccccaacctggacatcatcggcaagcggatcgagaagatcaagcaggagcacgagacctcctggcactacgaccaggaccacccctacaagacctgggcgtaccacggcagctacgagacgaagcagaccgggtccgccagctccatggtcaacggcgtggtgcgcctcctgaccaagccctgggacgtcgtgccgatggtgacccagatggccatgacggacaccacccccttcgggcagcagcgggtcttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtgcgcagcaacgccgcgctgggggccatcttcaccgacgagaacaagtggaagtccgcccgggaggccgtcgaggacagccgcttctgggagctcatcgaccgggagcgcaacctgcacctggagggcaagtgcgagacctgcgtgtacaacatgatggggaagcgggagaagaagctcggcgagttcgggaaggcgaagggcagccgcgccatctggtacatgtggctgggcgcccggttcctggagttcgaggccctcgggttcctgaacgaggaccactggttctcccgcggcaacagcctgtccggggtggagggcgaggggctccaccggctgggctacatcctgcgcgacgtcagcaagaaggagggcggggccatgtacgcggacgacacggccggctgggacacccggatcaccctcgaggacctgaagaacgaggagatggtgaccaaccacatgaagggggagcacaagaagctggccgaggccatcttcaagctcacgtaccagaacaaggtcgtgcgcgtgcagcggccgacgccccggggcaccgtcatggacatcatctcccgccgggaccagcgcgggagcggccaggtgggcacctacgggctgaacacgttcaccaacatggaggcccagctgatccggcagatggagggcgaggggatcttcaagtccatccagcacctcaccgtgaccgaggagatcgcggtccagaactggctggcccgcgtgggccgggagcgcctgagccggatggccatctccggcgacgactgcgtggtcaagcccctcgacgaccgcttcgccagcgccctgacggcgctgaacgacatggggaaggtgcggaaggacatccagcagtgggagccctcccgcggctggaacgactggacccaggtgccgttctgcagccaccacttccacgagctcgtcatgaaggacgggcgggtgctggtggtcccctgccgcaaccaggacgagctgatcggccgggcccgcatctcccagggggccggctggagcctcaaggagaccgcctgcctgggcaagtcctacgcccagatgtggaccctgatgtacttccaccggcgcgacctccggctggcggccaacgccatctgcagcgccgtgccctcccactgggtgcccacgagccgcaccacctggagcatccacgcgaagcacgagtggatgaccaccgaggacatgctggccgtctggaaccgggtgtggatccaggagaacccgtggatggaggacaagacgcccgtggagtcctgggaggaggtcccctacctcgggaagcgcgaggaccagtggtgcggcagcctgatcgggctgacctcccgcgccacctgggccaagaacatccagaccgccatcaaccaggtgcggagcctcatcggcaacgaggagtacacggactacatgccctccatgaagcgcttccggcgcgaggaggaggaggcgggggtgctgtggtga

SEQ ID NO: 9756 - RNA, 9876 nt, synthetic construct
  misc_feature 1..9876: note = derived and/or modified CDS sequence (opt1) from DENV-2__GQ398272__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcatcacccaggagtccgagagcaacatcctggacatcgacctccgcccggcctccgcctggaccctgtacgccgtggccacgaccttcgtcacccccatgctgcggcacagcatcgagaactccagcgtgaacgtgtccctcaccgcgatcgccaaccaggccacggtcctgatggggctgggccgcgggtggcccctcagcaagatggacatcggcgtgcccctgctggccatcgggtgctactcccaggtgaacccgatcaccctcatcgcggccctgctgctcctggtcgcccactacgccatcatcggccccggcctgcaggccaaggcgacccgcgaggcccagaagcgggccgccgccgggatcatgaagaaccccaccgtggacggcatcacggtgatcgacctcgagcccatcccgtacgaccccaagttcgagaagcagctggggcaggtcatgctgctcgtgctgtgcgtgacccaggtcctgatgatgcgcaccacctgggcgctctgcgaggccctgacgctggccaccggccccatcagcaccctctgggaggggaaccccggccggttctggaacaccacgatcgccgtgtccatggccaacatcttccgcggcagctacctggcgggggccggcctcctcttctccatcatgaagaacaccaccaacacccggcgcgggacgggcaacatcggcgagaccctgggggagaagtggaagtcccggctgaacgccctcggcaagtccgagttccagatctacaagaagtccgggatccaggaggtggaccgcaccctggccaaggagggcatcaagcgcggggagaccgaccaccacgcggtctcccgcggcagcgccaagctgcggtggttcgtggagcgcaacatggtgacgccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacctacggctggaacctcgtgcggctgcagagcggggtggacgtcttcttcaccccgcccgagaagtgcgacacgctgctctgcgacatcggcgagtccagccccaaccccaccatcgaggccggccgcaccctgcgggtgctgaacctcgtggagaactggctgaacaacaacacccagttctgcatcaaggtcctgaacccgtacatgccctccgtgatcgagaagatggagacgctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcaccatgaagcacaagaaggcgacctacgagccggacgtcgacctcggcagcgggacgcgcaacatcggcatcgagaacgagatccccaacctggacatcatcggcaagcggatcgagaagatcaagcaggagcacgagacctcctggcactacgaccaggaccacccctacaagacctgggcctaccacgggagctacgagaccaagcagacgggctccgccagctccatggtgaacggggtggtccgcctgctcaccaagccctgggacgtggtgccgatggtcacccagatggccatgaccgacacgacccccttcggccagcagcgggtgttcaaggagaaggtggacacccgcacccaggagcccaaggagggcacgaagaagctgatgcggatcaccgccgagtggctgtggaaggagctcgggaagaagaagacgccccggatgtgcacccgggaggagttcacgcgcaaggtccggagcaacgcggccctgggcgccatcttcaccgacgagaacaagtggaagtccgcccgcgaggccgtggaggacagccggttctgggagctggtcgaccgcgagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtcagcaagaaggagggcggcgcgatgtacgccgacgacaccgccgggtgggacacgcggatcaccctggaggacctcaagaacgaggagatggtgaccaaccacatgaagggcgagcacaagaagctggccgaggccatcttcaagctgacctaccagaacaaggtggtccgcgtgcagcgcccgacgccccgggggaccgtgatggacatcatctcccgcaaggaccagcggggcagcggccaggtcgggacctacggcctcaacaccttcacgaacatggaggcgcagctgatccgccagatggagggggagggcatcttcaagtccatccagcacctgaccgtgaccgaggagatcgccgtgcagaactggctcgcccgggtcggccgcgagcggctgagccgcatggccatctccggggacgactgcgtggtgaagcccctggacgaccggttcgccagcgcgctcaccgccctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgccggctggagcctgaaggagaccgcctgcctcgggaagtcctacgcgcagatgtggaccctgatgtacttccaccgccgggacctgcgcctcgccgccaacgccatctgcagcgccgtcccctcccactgggtgcccaccagccggacgacctggtccatccacgcgaagcacgagtggatgaccaccgaggacatgctggccgtgtggaaccgcgtctggatccaggagaacccgtggatggaggacaagacccccgtggagagctgggaggaggtgccctacctgggcaagcgcgaggaccagtggtgcgggagcctcatcggcctgacgtcccgggccacctgggccaagaacatccagaccgcgatcaaccaggtccgcagcctgatcgggaacgaggagtacaccgactacatgccctccatgaagcggttccgcaaggaggaggaggaggccggcgtgctctggtga

SEQ ID NO: 9757 - RNA, 9876 nt, synthetic construct
  misc_feature 1..9876: note = derived and/or modified CDS sequence (opt1) from DENV-2__GQ398292__SS-prME
  source 1..9876: mol_type = other RNA
accgccggcgtcttcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcatgcgccacccgggcttcaccatcatggccgcgatcctggcctacaccatcgggaccacccacttccagcgggccctgatcttcatcctcctgaccgccgtggcgcccagcatgaccatgcgctgcatcggcatctccaaccgggacttcgtggagggcgtcagcgggggctcctgggtggacatcgtgctggagcacgggagctgcgtcaccacgatggccaagaacaagcccaccctcgacttcgagctgatcaagaccgaggccaagcagcccgccaccctgcgcaagtactgcatcgaggccaagctcacgaacaccaccaccgagtcccggtgcccgacgcagggcgagcccagcctgaacgaggagcaggacaagcgcttcgtgtgcaagcactccatggtggaccggggctgggggaacggctgcgggctgttcggcaagggcgggatcgtgacctgcgcgatgttcacgtgcaagaagaacatggagggcaaggtggtgctccccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctgctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctggagaagcggcacgtgctcgggcgcctgatcaccgtgaacccgatcgtcgcggagaaggacagccccgtgaacatcgaggccgagccgcccttcggcgactcctacatcatcatcggggtggagccgggccagctgaagctcaactggttcaagaaggggagctccatcggccagatgttcgagaccaccatgcgcggcgccaagcggatggccatcctgggggacacggcctgggacttcggcagcctcggcggggtcttcacctccatcgggaaggcgctccaccaggtgttcggggccatctacggcgccgccttcagcggggtgtcctggaccatgaagatcctgatcggcgtcatcatcacctggatcgggatgaacagccgctccacgagcctgtccgtgagcctggtgctcgtcggcgtggtgaccctgtacctgggggcgatggtccaggccgactccggctgcgtggtgagctggaagtccaaggagctcaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctggagaacctcatgtggaagcagatcacccccgagctgaaccacatcctgagcgagaacgaggtgaagctcaccatcatgacgggcgacatcaaggggatcatgcaggcgggcaagcggtccctgcgcccgcagcccaccgagctgaagtacagctggaagacctggggcaaggccaagatgctctccaccgagagccacaaccagacgttcctgatcgacgggcccgagaccgccgagtgcccgaacaccaaccgggcctggaactccctggaggtcgaggactacggcttcggggtgttcaccacgaacatctggctcaagctgcgcgagaagcaggacgtgttctgcgacagcaagctgatgtccgccgcgatcaaggacaaccgggccgtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgcggggcccgtgagccagcacaactaccgcccgggctaccacacccagaccgccgggccctggcacctcggcaagctggagatggacttcgacttctgcgaggggacgaccgtggtggtcaccgaggactgcggcaaccggggccccagcctgcgcaccacgaccgcctccgggaagctcatcaccgagtggtgctgccggagctgcaccctgcccccgctgcgctaccggggcgaggacgggtgctggtacggcatggagatccgccccctcaaggagaaggaggagaacctggtgaactccctggtgacggccgggcacggccagatcgacaacttcagcctcggcgtcctggggatggcgctgttcctcgaggagatgctgcggacccgcgtgggcaccaagcacgccatgctgctcgtggccgtctccttcgtgaccctgatcacggggaacatgagcttccgggacctgggccgcgtgatggtcatggtgggggccaccatgaccgacgacatcggcatgggcatcacctacctcgccctgctggcggccttcaaggtgcgccccacgttcgccgccgggctcctgctgcggaagctcacctccaaggagctgatgatggccaccatcggcatcgcgctgctcagccagtccaccatccccgagacgatcctggagctgaccgacgccctcgccctggggatgatggtcctgaagatcgtgcgcaacatggagaagtaccagctcgccgtgaccatcatggccatcagctgcgtcccgaacgcggtgatcctgcagaacgcctggaaggtgtcctgcaccatcctggccgccgtcagcgtgagccccctgctgctgacgagctcccagcagaaggcggactggatccccctcgccctgaccatcaagggcctgaaccccaccgccatcttcctcaccacgctgagccggacctccaagaagcgcagctggccgctgaacgaggccatcatggccgtcggcatggtgtccatcctcgcgagcagcctgctgaagaacgacatccccatgaccgggcccctcgtggccggcgggctgctgaccgtctgctacgtgctcacgggccggtccgccgacctggagctggagcgcgccgccgacgtgaagtgggaggaccaggcggagatcagcgggtccagccccatcctctccatcaccatcagcgaggacggctccatgagcatcaagaacgaggaggaggagcagaccctgaccatcctgatccggacgggcctcctggtcatctccggggtgttcccggtgagcatccccatcaccgccgccgcctggtacctgtgggaggtcaagaagcagcgcgccggcgtgctctgggacgtgcccagcccgccgcccgtcgggaaggcggagctggaggacggcgcctaccggatcaagcagcgcgggatcctgggctacagccagatcggcgccggggtgtacaaggagggcaccttccacaccatgtggcacgtgacccgcggggccgtcctcatgcaccgcggcaagcggatcgagccctcctgggccgacgtgaagaaggacctgatcagctacgggggcggctggaagctggagggggagtggaaggagggcgaggaggtgcaggtcctcgcgctggagcccgggaagaacccccgcgccgtgcagacgaagcccggcctgttcaagaccaacaccgggaccatcggcgccgtgtccctcgacttcagccccggcacgtccgggagccccatcgtcgaccggaagggcaaggtggtggggctgtacggcaacggcgtcgtgacccgctccggggcctacgtgagcgcgatcgcccagaccgagaagtccatcgaggacaaccccgagatcgaggacgacatcttccggaagaagcgcctgaccatcatggacctccaccccggcgccgggaagacgaagcggtacctgcccgccatcgtccgcgaggccatcaagcggggcctgcgcaccctgatcctcgcgccgacccgcgtggtggccgccgagatggaggaggccctgcgggggctgcccatccgctaccagacccccgccatccgggcggagcacacgggccgcgagatcgtcgacctcatgtgccacgccaccttcaccatgcggctgctgtcccccgtgcgcgtgccgaactacaacctcatcatcatggacgaggcccacttcaccgaccccgccagcatcgccgcgcggggctacatctccacgcgcgtcgagatgggggaggccgccggcatcttcatgaccgccacgccgcccgggagccgggacccgttcccccagtccaacgcgcccatcatggacgaggagcgcgagatccccgagcggagctggaactccggccacgagtgggtgaccgacttcaaggggaagacggtgtggttcgtcccgagcatcaaggccggcaacgacatcgccgcctgcctgcgcaagaacggcaagaaggtgatccagctgtcccggaagaccttcgacagcgagtacgtgaagacccgcgccaacgactgggacttcgtcgtgaccacggacatctccgagatgggggcgaacttcaaggccgagcgggtgatcgacccccgccggtgcatgaagcccgtcatcctcaccgacggcgaggagcgcgtgatcctggccgggcccatgccggtgacccacagctccgccgcccagcggcgcggccgcatcgggcggaaccccaagaacgagaacgaccagtacatctacatgggcgagcccctggagaacgacgaggactgcgcgcactggaaggaggccaagatgctcctggacaacatcaacacccccgagggcatcatcccgagcatgttcgagcccgagcgcgagaaggtcgacgccatcgacggggagtaccggctgcgcggcgaggcccggaagacgttcgtggacctcatgcgccgcggggacctgcccgtgtggctggcctaccgcgtcgcggccgagggcatcaactacgccgaccggcgctggtgcttcgacgggatcaagaacaaccagatcctcgaggagaacgtggaggtggagatctggaccaaggagggcgagcggaagaagctgaagccgcgctggctggacgcccggatctactccgaccccctcgcgctgaaggagttcaaggagttcgccgccggccgcaagagcctgaccctcaacctgatcaccgagatggggcggctgcccacgttcatgacccagaaggcccgcgacgccctcgacaacctggcggtcctgcacaccgccgaggccggcgggcgggcctacaaccacgccctctccgagctgcccgagaccctggagacgctcctgctgctcaccctgctggcgaccgtgaccggcggcatcttcctcttcctgatgagcgggaagggcatcgggaagatgacgctgggcatgtgctgcatcatcaccgcctccatcctcctgtggtacgcccagatccagccgcactggatcgccgccagcatcatcctggagttcttcctcatcgtcctgctgatccccgagcccgagaagcagcgcacgccccaggacaaccagctcacctacgtggtgatcgcgatcctgaccgtcgtggccgccacgatggccaacgagatggggttcctggagaagaccaagaaggacctcggcctgggcagcatcgccacccaggagtccgagagcaacatcctggacatcgacctccggccggcgtccgcctggaccctgtacgccgtggccacgaccttcgtcacccccatgctgcgccacagcatcgagaactccagcgtgaacgtgtccctcaccgcgatcgccaaccaggccacggtcctgatggggctgggcaaggggtggcccctcagcaagatggacatcggcgtgcccctgctggccatcgggtgctactcccaggtgaacccgatcaccctcaccgccgcgctgctgctcctggtcgcccactacgccatcatcggccccggcctgcaggccaaggccacccgggaggcgcagaagcgcgccgccgccgggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcgcaccacgtgggccctctgcgaggcgctgaccctggccaccggccccatcagcaccctctgggaggggaaccccggccggttctggaacacgaccatcgccgtctccatggccaacatcttccgcggcagctacctggcgggggccggcctcctcttctccatcatgaagaacaccaccaacacgcggcgcgggaccggcaacatcggcgagaccctgggggagaagtggaagtcccggctgaacgccctcggcaagtccgagttccagatctacaagaagtccgggatccaggaggtggaccgcaccctggccaaggagggcatcaagcgcggggagacggaccaccacgccgtgtcccgcggcagcgcgaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgaccaagggcggccccgggcacgaggagcccatccccatgagcacctacggctggaacctcgtccggctgcagagcggggtggacgtgttcttcacgccgcccgagaagtgcgacaccctgctctgcgacatcggcgagtccagccccaaccccaccatcgaggccggccgcaccctgcgggtcctgaacctcgtggagaactggctgaacaacaacacgcagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccaccgggaacatcgtctccagcgtgaacatgatctcccggatgctgatcaaccgcttcaccatgaagcacaagaaggccacgtacgagccggacgtggacctcggcagcgggacccgcaacatcggcatcgagtccgagatccccaacctggacatcatcggcaagcggatcgagaagatcaagcaggagcacgagaccagctggcactacgaccaggaccacccctacaagacctgggcgtaccacgggtcctacgagacgaagcagaccggcagcgcctccagcatggtcaacggggtggtgcgcctgctcaccaagccctgggacgtcgtgccgatggtgacccagatggccatgacggacaccacccccttcggccagcagcgggtcttcaaggagaaggtggacacccgcacgcaggagcccaaggagggcaccaagaagctgatgaagatcaccgccgagtggctgtggaaggagctcgggaagaagaagacgccccggatgtgcacgcgcgaggagttcacccggaaggtgcgctccaacgccgcgctgggcgccatcttcaccgacgagaacaagtggaagtccgcccgggaggccgtcgaggactcccgcttctgggagctgatcgaccgggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttcagccgcgggaactccctgagcggcgtggagggggagggcctgcaccggctcggctacatcctgcgcgacgtctccaagaaggagggcggcgccatgtacgcggacgacacggccgggtgggacacccggatcaccctggaggacctcaagaacgaggagatggtgaccaaccacatgaagggcgagcacaagaagctggccgaggccatcttcaagctgacgtaccagaacaaggtcgtgcgcgtgcagcggccgacgccccgggggaccgtcatggacatcatcagccgccgggaccagcgcggctccggccaggtggggacctacggcctcaacacgttcaccaacatggaggcccagctgatccggcagatggagggggagggcatcttcaagagcatccagcacctgaccgtgaccgaggagatcgcggtccagaactggctcgcccgcgtgggccgggagcgcctgtcccggatggccatcagcggggacgactgcgtggtcaagcccctggacgaccgcttcgcctccgccctcacggcgctgaacgacatgggcaaggtgcggaaggacatccagcagtgggagcccagccgcgggtggaacgactggacccaggtgccgttctgctcccaccacttccacgagctggtcatgaaggacggccgggtgctcgtggtcccctgccgcaaccaggacgagctgatcgggcgggcccgcatcagccagggcgccggctggtccctgaaggagaccgcctgcctcggcaagagctacgcccagatgtggaccctgatgtacttccaccggcgcgacctgcggctcgcggccaacgccatctgctccgccgtgcccagccactgggtgcccacgtcccgcaccacctggagcatccacgcgaagcacgagtggatgaccaccgaggacatgctggccgtctggaaccgggtgtggatccaggagaacccgtggatggaggacaagacgcccgtggagagctgggaggaggtcccctacctgggcaagcgcgaggaccagtggtgcgggtccctcatcggcctgaccagccgcgccacctgggccaagaacatccagaccgccatcaaccaggtgcggtccctgatcgggaacgaggagtacacggactacatgcccagcatgaagcgcttccggcgcgaggaggaggaggcgggcgtgctctggtga

SEQ ID NO: 9758 - RNA, 9876 nt, synthetic construct
  misc_feature 1..9876: note = derived and/or modified CDS sequence (opt1) from DENV-2__GQ398267__SS-prME
  source 1..9876: mol_type = other RNA
accgccgggatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccagcaagaagcggtcctggccgctcaacgaggcgatcatggccgtgggcatggtcagcatcctggcctccagcctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatctccggcagctcccccatcctgagcatcaccatctccgaggacgggagcatgtccatcaagaacgaggaggaggagcagaccctgacgatcctcatccggaccggcctgctggtgatcagcggcctcttcccggtctccatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtactcccagatcggcgccggcgtgtacaaggaggggaccttccacaccatgtggcacgtcacgcgcggcgcggtgctgatgcacaaggggaagcggatcgagcccagctgggccgacgtgaagaaggacctcatctcctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtcagcctggacttctcccccggcaccagcggctcccccatcgtggacaagaaggggaaggtggtcggcctctacgggaacggcgtggtgacccggagcggcacctacgtctccgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgcctccatcgcggcccgcggctacatcagcacccgggtcgagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtgaccgacttcaagggcaagaccgtgtggttcgtcccgtccatcaaggccgggaacgacatcgccgcctgcctccggaagaacggcaagaaggtgatccagctgagccgcaagaccttcgactccgagtacatcaagacgcggaccaacgactgggacttcgtggtcaccaccgacatcagcgagatgggcgcgaacttcaaggccgagcgcgtgatcgacccccggcgctgcatgaagcccgtgatcctgacggacggggaggagcgggtcatcctcgccggccccatgccggtgacccactccagcgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctacagcgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggcagcatcaccacccagcagccggagagcaacatcctcgacatcgacctgcggcccgcctccgcgtggaccctgtacgccgtcgccacgaccttcatcacccccatgctccgccacagcatcgagaactccagcgtgaacgtgtccctgaccgccatcgccaaccaggcgacggtcctgatgggcctcgggaagggctggcccctgagcaagatggacatcggggtgccgctgctcgccatcggctgctactcccaggtgaaccccatcaccctgatcgccgccctgctcctgctggtcgcgcactacgccatcatcgggcccggcctccaggccaaggccacccgggaggcccagaagcgcgcggccgccggcatcatgaagaaccccaccgtggacgggatgacggtgatcgacctggacccgatcccctacgaccccaagttcgagaagcagctgggccaggtcatgctcctggtgctgtgcgtgacccaggtcctcatgatgcggaccacctgggccctgtgcgaggccctgacgctcgcgaccgggcccatcagcaccctgtgggagggcaacccggggcgcttctggaacaccacgatcgccgtgtccatggccaacatcttccgcggcagctacctggccggcgccgggctcctgttctccatcatgaagaacaccgcgaacacccggcgcggcaccgggaacatcggcgagacgctgggcgagaagtggaagaaccggctcaacgccctgggcaagagcgagttccagatctacaagaagtccggcatccaggaggtggaccgcaccctggccaaggaggggatcaagcggggcgagaccgaccaccacgccgtcagccgcgggtccgcgaagctccggtggttcgtggagcgcaacctggtgacccccgagggcaaggtcgtggacctgggctgcgggcggggcgggtggagctactactgcggcgggctcaagaacgtgaaggaggtcaagggcctgacgaagggcgggcccggccacgaggagcccatcccgatgtccacctacgggtggaacctggtgcgcctccagagcggcgtggacgtcttcttcacgccgcccgagaagtgcgacaccctgctgtgcgacatcggggagtccagccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacccacgagatgtactgggtgtccaacgccagcggcaacatcgtgtccagcgtcaacatgatctcccgcatgctgatcaaccggttcaccatgcgccacaagaaggcgacgtacgagcccgacgtggacctggggagcggcacccggaacatcgggatcgagtccgagacccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtgaacggcgtcgtgcgcctgctgaccaagccgtgggacgtgatccccatggtcacgcagatggccatgaccgacaccacccccttcgggcagcagcgggtgttcaaggagaaggtcgacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgctccaacgcggccctcggggccatcttcaccgacgagaacaagtggaagtccgcccgggaggccgtggaggactccggcttctgggagctggtcgacaaggagcgcaacctgcacctcgaggggaagtgcgagacgtgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagcctcagcggggtggagggcgaggggctgcacaagctgggctacatcctccgggacgtctccaagaaggagggcggggcgatgtacgccgacgacaccgccggctgggacacccgcatcaccctggaggacctgaagaacgaggagatggtgacgaaccacatggagggggagcacaagaagctcgccgaggccatcttcaagctgacctaccagaacaaggtggtccgggtgcagcgccccacgccccggggcaccgtgatggacatcatcagccgccgggaccagcgcgggtccggccaggtcgtgacgtacggcctgaacaccttcaccaacatggaggcgcagctcatccggcagatggagggggagggcgtgttcaagagcatccagcagctgaccgtcaaggaggagatcgccgtgaagaactggctgatccgcgtggggcgcgagcggctctcccgcatggccatcagcggcgacgactgcgtcgtgaagcccctggacgaccggttcgcctccgccctgatcgcgctcaacgacatgggcaaggtgcgcaaggacatccagcagtgggagccgagccgggggtggaacgactggacgcaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtgccctcccactgggtgccgaccagccgcaccacgtggtccatccacgccacccacgagtggatgaccaccgaggacatgctcaccgtctggaaccgggtgtggatccaggagaacccctggatggaggacaagacgcccgtggagagctgggaggagatcccctacctgggcaagcgcgaggaccagtggtgcgggagcctgatcggcctcacctcccgggcgacctgggccaagaacatccagaccgccatcaaccaggtccgcagcctgatcgggaacgaggagtacacggactacatgccgtccatgaagcggttccgccgcgaggaggaggaggccggcgtgctgtggtga

SEQ ID NO: 9759 - RNA, 9876 nt, synthetic construct
  misc_feature 1..9876: note = derived and/or modified CDS sequence (opt1) from DENV-2__GQ398266__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccaacaagaagcggagctggccgctcaacgaggcgatcatggccgtgggcatggtctccatcctggccagctccctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttcccggtcagcatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtacagccagatcggcgccggcgtgtacaaggaggggaccttccacaccatgtggcacgtcacgcgcggcgcggtgctgatgcacaaggggaagcggatcgagccctcctgggccgacgtgaagaaggacctcatcagctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtctccctggacttcagccccggcacctccggcagccccatcgtggacaagaaggggaaggtggtcggcctctacgggaacggcgtggtgacccggtccggcacctacgtcagcgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgccagcatcgcggcccgcggctacatctccacccgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctccggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctgacggacggggaggagcgggtcatcctcgccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctactccgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgtccgagctccccgagaccctggagaccctgctcctgctgacgctcctggcgaccgtcaccgggggcatcttcctgttcctcatgagcggcaaggggatcggcaagatgaccctggggatgtgctgcatcatcaccgcctccatcctgctctggtacgcccagatccagccgcactggatcgccgccagcatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggctccatcaccacccagcagccggagagcaacatcctcgacatcgacctgcggcccgccagcgcgtggaccctgtacgccgtcgccacgaccttcatcacccccatgctccgccactccatcgagaacagctccgtgaacgtgagcctgaccgccatcgccaaccaggcgacggtcctgatgggcctcgggaagggctggcccctgtccaagatggacatcggggtgccgctgctcgccatcggctgctacagccaggtgaaccccatcaccctgatcgccgccctgctcctgctggtcgcgcactacgccatcatcgggcccggcctccaggccaaggccacccgggaggcccagaagcgcgcggccgccggcatcatgaagaaccccaccgtggacgggatgacggtgatcgacctggacccgatcccctacgaccccaagttcgagaagcagctgggccaggtcatgctcctggtgctgtgcgtgacccaggtcctcatgatgcggaccacctgggccctgtgcgaggccctgacgctcgcgaccgggcccatctccaccctgtgggagggcaacccggggcgcttctggaacaccacgatcgccgtgagcatggccaacatcttccgcggctcctacctggccggcgccgggctcctgttcagcatcatgaagaacaccgcgaacacccggcgcggcaccgggaacacgggcgagaccctgggcgagaagtggaagaaccggctcaacgccctggggaagtccgagttccagatctacaagaagtccggcatccaggaggtggaccgcaccctggccaaggaggggatcaagcggggcgagaccgaccaccacgccgtctcccgcgggagcgcgaagctccggtggttcgtggagcgcaacctggtgacgcccgagggcaaggtcgtggacctgggctgcgggcggggcgggtggtcctactactgcggcgggctcaagaacgtgaaggaggtcaagggcctgaccaagggcgggcccggccacgaggagcccatcccgatgagcacctacgggtggaacctggtgcgcctccagtccggcgtggacgtcttcttcacgccgcccgagaagtgcgacacgctgctgtgcgacatcggggagagctcccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctcagccggaactccacccacgagatgtactgggtgagcaacgcctccggcaacatcgtgagctccgtcaacatgatcagccgcatgctgatcaaccggttcacgatgcgccacaagaaggcgacctacgagcccgacgtggacctggggtccggcacccggaacatcgggatcgagagcgagacccccaacctcgacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtcgtgcgcctgctgacgaagccgtgggacgtgatccccatggtcacccagatggccatgaccgacaccacgcccttcgggcagcagcgggtgttcaaggagaaggtcgacacccgcacccaggagcccaaggagggcaccaagaagctcatgaagatcacggccgagtggctgtggaaggagctgggcaagaagaagaccccgcggatgtgcacccgcgaggagttcacccggaaggtgcgcagcaacgcggccctcggggccatcttcacggacgagaacaagtggaagtccgcccgggaggccgtggaggacagcggcttctgggagctggtcgacaaggagcgcaacctgcacctcgaggggaagtgcgagacctgcgtgtacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaactccctcagcggggtggagggcgaggggctgcacaagctgggctacatcctccgggacgtcagcaagaaggagggcggggcgatgtacgccgacgacaccgccggctgggacacccgcatcacgctggaggacctgaagaacgaggagatggtgaccaaccacatggagggggagcacaagaagctcgccgaggccatcttcaagctgacctaccagaacaaggtggtccgggtgcagcgccccacgccccggggcacggtgatggacatcatctcccgccgggaccagcgcgggagcggccaggtcgtgacctacggcctgaacaccttcaccaacatggaggcgcagctcatccggcagatggagggggagggcgtgttcaagtccatccagcagctgacggtcaaggaggagatcgccgtgaagaactggctgatccgcgtggggcgcgagcggctcagccgcatggccatctccggcgacgactgcgtcgtgaagcccctggacgaccggttcgccagcgccctgaccgcgctcaacgacatgggcaaggtgcgcaaggacatccagcagtgggagccgtcccgggggtggaacgactggacccaggtccccttctgcagccaccacttccacgagctgatcatgaaggacggccgcgtgctggtggtcccctgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtgcccagccactgggtgccgacgtcccgcaccacctggagcatccacgccacccacgagtggatgaccacggaggacatgctcaccgtctggaaccgggtgtggatccaggagaacccctggatggaggacaagacccccgtggagtcctgggaggagatcccctacctgggcaagcgcgaggaccagtggtgcgggagcctgatcggcctcaccagccgggcgacgtgggccaagaacatccagaccgccatcaaccaggtccgctccctgatcgggaacgaggagtacaccgactacatgccgagcatgaagcggttccgccgcgaggaggaggaggccggcgtgctgtggtga

SEQ ID NO: 9760 - RNA, 9876 nt, synthetic construct
  misc_feature 1..9876: note = derived and/or modified CDS sequence (opt1) from DENV-2__GQ398265__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacgtacgggacctgcaccgccaccggcgagcaccggcgcgagaagcggagcgtcgccctggtgccccacgtgggcatggggctggagacgcgcaccgagacctggatgtccagcgagggcgcctggaagcacgcccagcggatcgagacctggatcctccgccaccccgggttcacgatcatggcggccatcctggcctacaccatcggcaccacctacttccagcgggtcctgatcttcatcctcctgacggccgtgaccccctccatggcgatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcgtggaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaaggtggtccagcccgagaacctcgagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctggacttcaacgagatggtgctcctgcagatggagaacaaggcctggctggtccaccggcagtggttcctcgacctgcccctgccctggctcccgggcgcggacacccaggggtccaactggatccagaaggagaccctggtgacgttcaagaacccccacgccaagaagcaggacgtcgtggtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtcgtgaaggagatcgcggagacccagcacggcaccatcgtgatccgcgtccagtacgagggggacggcagcccctgcaagatccccttcgagatcatggacctggagaagcggcacgtgctgggccgcctcatcacggtgaacccgatcgtcaccgagaaggactcccccgtgaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtcttcacctccatcggcaaggcgctgcaccaggtgttcggggccatctacggcgccgccttcagcggcgtgtcctggaccatgaagatcctcatcggggtcgtgatcacctggatcggcatgaacagccgctccacgagcctgtccgtgagcctggtcctggtgggggtggtcaccctctacctgggcgtgatggtgcaggcggactccgggtgcgtcgtgagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgaccgagaacgaggtgaagctgacgatcatgaccggggacatcaagggcatcatgcaggccgggaagcggtccctccgcccgcagcccaccgagctgaagtacagctggaaggcgtggggcaaggccaagatgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgttctgcgactccaagctgatgagcgccgcgatcaaggacaaccgggccgtgcacgccgacatggggtactggatcgagtccgccctcaacgacacctggaagatcgagaaggccagcttcatcgaggtcaagtcctgccactggcccaagagccacaccctgtggtccaacggcgtgctggagagcgagatgatcatccccaagaacttcgcgggccccgtgtcccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgccagcggcaagctcatcaccgagtggtgctgccgctcctgcaccctgcccccgctgcggtaccgcggggaggacggctgctggtacgggatggagatccggcccctcaaggagaaggaggagaacctggtcaacagcctggtgacggccggccacgggcagatcgacaacttctccctcggcgtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcaccagcaaggagctgatgatgaccaccatcgggatcgtcctgctctcccagagcacgatccccgagtccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcaccacgctcgcggtggtctccgtgagccccctgctgctcacctccagccagcagaaggccgactggatccccctggccctgaccatcaaggggctcaaccccaccgccatcttcctgacgaccctgtcccgcaccaacaagaagcggagctggccgctcaacgaggcgatcatggccgtgggcatggtctccatcctggccagctccctgctcaagaacgacatccccatgaccggccccctggtggccgggggcctgctcacggtgtgctacgtcctgaccgggcgcagcgccgacctggagctcgagcgggcggccgacgtgcgctgggaggagcaggccgagatcagcggctccagccccatcctgtccatcaccatcagcgaggacgggtccatgagcatcaagaacgaggaggaggagcagaccctgacgatcctcatccggaccggcctgctggtgatctccggcctcttcccggtcagcatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtacagccagatcggcgccggcgtgtacaaggaggggaccttccacaccatgtggcacgtcacgcgcggcgcggtgctgatgcacaaggggaagcggatcgagccctcctgggccgacgtgaagaaggacctcatcagctacggcgggggctggaagctggagggcgagtggaaggagggggaggaggtccaggtgctggccctcgagcccggcaagaacccccgcgccgtgcagaccaagcccgggctgttcaagaccaacaccggcacgatcggggccgtctccctggacttcagccccggcacctccggcagccccatcgtggacaagaaggggaaggtggtcggcctctacgggaacggcgtggtgacccggtccggcacctacgtcagcgcgatcgcccagacggagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggaccctgatcctggccccgacgcgcgtggtcgccgccgagatggaggaggccctccgcggcctgcccatccggtaccagacccccgcgatccgcgccgagcacaccgggcgggagatcgtggacctgatgtgccacgccaccttcacgatgcgcctcctgagccccatccgggtgccgaactacaacctgatcatcatggacgaggcccacttcaccgaccccgccagcatcgcggcccgcggctacatctccacccgggtcgagatgggcgaggccgccgggatcttcatgaccgccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctccggaagaacggcaagaaggtgatccagctgtcccgcaagaccttcgacagcgagtacatcaagacgcggaccaacgactgggacttcgtggtcaccaccgacatctccgagatgggcgcgaacttcaaggccgagcgcgtgatcgacccccggcgctgcatgaagcccgtgatcctgacggacggggaggagcgggtcatcctcgccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtcgacgccatcgacggcgagtaccgcctgcgcggggaggcccgcaagaccttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggacgaaggagggggagcgcaagaagctcaagccgcggtggctggacgcccgcatctactccgaccccctggccctcaaggagttcaaggagttcgcggccggccggaagtccctgaccctgaacctcatcaccgagatgggccgcctgcccaccttcatgacgcagaaggccaagaacgccctggacaacctcgcggtgctgcacaccgccgaggccgggggccgggcctacaaccacgccctgtccgagctccccgagaccctggagaccctgctcctgctgacgctcctggcgaccgtcaccgggggcatcttcctgttcctcatgagcggcaaggggatcggcaagatgaccctggggatgtgctgcatcatcaccgcctccatcctgctctggtacgcccagatccagccgcactggatcgccgccagcatcatcctggagttcttcctgatcgtgctcctgatccccgagcccgagaagcagcgcacgccccaggacaaccagctgacctacgtggtcatcgcgatcctcaccgtggtggccgccaccatggccaacgagatgggcttcctggagaagacgaagaaggacttcgggctgggctccatcaccacccagcagccggagagcaacatcctcgacatcgacctgcggcccgccagcgcgtggaccctgtacgccgtcgccacgaccttcatcacccccatgctccgccactccatcgagaacagctccgtgaacgtgagcctgaccgccatcgccaaccaggcgacggtcctgatgggcctcgggaagggctggcccctgtccaagatggacatcggggtgccgctgctcgccatcggctgctacagccaggtgaaccccatcaccctgaccgccgccctgctcctgctggtcgcgcactacgccatcatcgggcccggcctccaggccaaggccacccgggaggcccagaagcgcgcggccgccggcatcatgaagaaccccacggtggacgggatgaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgcgaccgggcccatctccaccctgtgggagggcaacccggggcgcttctggaacacgaccatcgccgtgagcatggccaacatcttccgcggctcctacctggccggcgccgggctcctgttcagcatcatgaagaacaccgcgaacacccggcgcggcacggggaacaccggcgagaccctgggcgagaagtggaagaaccggctcaacgccctggggaagtccgagttccagatctacaagaagtccggcatccaggaggtggaccgcaccctggccaaggaggggatcaagcggggcgagacggaccaccacgccgtctcccgcgggagcgcgaagctccggtggttcgtggagcgcaacctggtgacccccgagggcaaggtcgtggacctgggctgcgggcggggcgggtggtcctactactgcggcgggctcaagaacgtgaaggaggtcaagggcctgaccaagggcgggcccggccacgaggagcccatcccgatgagcacctacgggtggaacctggtgcgcctccagtccggcgtggacgtcttcttcacgccgcccgagaagtgcgacaccctgctgtgcgacatcggggagagctcccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctcagccggaactccacgcacgagatgtactgggtgagcaacgcctccggcaacatcgtgagctccgtcaacatgatcagccgcatgctgatcaaccggttcaccatgcgccacaagaaggcgacctacgagcccgacgtggacctggggtccggcacccggaacatcgggatcgagagcgagacgcccaacctcgacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctgaccaagccgtgggacgtgatccccatggtcacccagatggccatgaccgacacgacccccttcgggcagcagcgggtgttcaaggagaaggtcgacacccgcacccaggagcccaaggagggcacgaagaagctcatgaagatcaccgccgagtggctgtggaaggagctgggcaagaagaagaccccgcggatgtgcacccgcgaggagttcacgcggaaggtgcgcagcaacgcggccctcggggccatcttcaccgacgagaacaagtggaagtccgcccgggaggccgtggaggacagcggcttctgggagctggtcgacaaggagcgcaacctgcacctcgaggggaagtgcgagacctgcgtgtacaacatgatgggcaagcgggagaagaagctgggggagttcggcaaggcgaagggctcccgcgccatctggtacatgtggctgggggcccggttcctcgagttcgaggccctgggcttcctgaacgaggaccactggttcagccgcgagaactccctcagcggggtggagggcgaggggctgcacaagctgggctacatcctccgggacgtcagcaagaaggagggcggggcgatgtacgccgacgacaccgccggctgggacacgcgcatcaccctggaggacctgaagaacgaggagatggtgaccaaccacatggagggggagcacaagaagctcgccgaggccatcttcaagctgacctaccagaacaaggtggtccgggtgcagcgccccacgccccggggcaccgtgatggacatcatctcccgccgggaccagcgcgggagcggccaggtcgtgacctacggcctgaacaccttcacgaacatggaggcgcagctcatccggcagatggagggggagggcgtgttcaagtccatccagcagctgaccgtcaaggaggagatcgccgtgaagaactggctgatccgcgtggggcgcgagcggctcagccgcatggccatctccggcgacgactgcgtcgtgaagcccctggacgaccggttcgccagcgccctgaccgcgctcaacgacatgggcaaggtgcgcaaggacatccagcagtgggagccgtcccgggggtggaacgactggacccaggtccccttctgcagccaccacttccacgagctgatcatgaaggacggccgcgtgctggtggtcccctgccggaaccaggacgagctcatcgggcgcgcccggatctcccagggcgccgggtggagcctgcgcgagacggcctgcctgggcaagtcctacgcccagatgtggagcctcatgtacttccaccggcgcgacctgcggctggcggccaacgccatctgctccgccgtgcccagccactgggtgccgacctcccgcaccacctggagcatccacgccacccacgagtggatgacgaccgaggacatgctcaccgtctggaaccgggtgtggatccaggagaacccctggatggaggacaagacccccgtggagtcctgggaggagatcccctacctgggcaagcgcgaggaccagtggtgcgggagcctgatcggcctcacgagccgggcgacctgggccaagaacatccagaccgccatcaaccaggtccgctccctgatcgggaacgaggagtacaccgactacatgccgagcatgaagcggttccgccgcgaggaggaggaggccggcgtgctgtggtga

SEQ ID NO: 9761 - RNA, 9876 nt, synthetic construct
  misc_feature 1..9876: note = derived and/or modified CDS sequence (opt1) from DENV-2__KX702403__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcctgatcctgctcaccgccgtggcgcccagcatgaccatgcgctgcatcggcatctccaaccgggacttcgtcgagggcgtgagcgggggctcctgggtggacatcgtcctggagcacgggagctgcgtgaccacgatggccaagaacaagcccaccctggacttcgagctcatcaagaccgaggccaagcagcccgccaccctgcgcaagtactgcatcgaggccaagctgacgaacaccaccaccgagtcccggtgcccgacgcagggcgagcccagcctcaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctcacggggtacggcaccgtgaccatggagtgcagcccccggaccggcctggacttcaacgagatggtgctgctccagatggaggacaaggcctggctggtccaccggcagtggttcctggacctccccctgccctggctgccgggggccgacacgcagggcagcaactggatccagaaggagaccctcgtgaccttcaagaacccccacgcgaagaagcaggacgtggtcgtgctggggtcccaggagggcgccatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctcgagaagcggcacgtcctggggcgcctgatcaccgtgaacccgatcgtgacggagaaggacagccccgtcaacatcgaggcggagccgcccttcggcgactcctacatcatcgtgggggtggagccgggccagctcaagctgaactggttcaagaaggggagctccatcggccagatgttcgagaccaccatgcgcggcgccaagcggatggccatcctgggggacaccgcctgggacttcggcagcctcgggggcgtcttcacgtccatcgggaaggccctgcaccaggtgttcggcgcgatctacggcgccgccttcagcggggtgtcctggaccatgaagatcctgatcggcgtcatcatcacctggatcgggatgaacagccgctccaccagcctgtccgtgagcctcgtgctggtcggcgtggtgacgctgtacctcggggccatggtccaggcggactccggctgcatcgtgagctggaagaacaaggagctgaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctcgagaacctgatgtggaagcagatcacccccgagctgaaccacatcctctccgagaacgaggtgaagctgaccatcatgaccggcgacatcaaggggatcatgcaggccggcaagcggagcctgcgcccgcagcccacggagctcaagtactcctggaagacctggggcaaggcgaagatgctgagcaccgagtcccacaaccagaccttcctgatcgacgggcccgagacggccgagtgcccgaacaccaaccgggcctggaacagcctcgaggtggaggactacggcttcggggtcttcaccaccaacatctggctgaagctgcgcgagaagcaggacgtgttctgcgactccaagctcatgagcgccgccatcaaggacaaccgggcggtgcacgccgacatgggctactggatcgagtccgccctgaacgacacctggaagatggagaaggccagcttcatcgaggtcaagtcctgccactggcccaagagccacacgctgtggtccaacggcgtgctcgagagcgagatgatcatccccaagaacttcgccgggcccgtgtcccagcacaactaccgcccgggctaccacacccagaccgcggggccctggcacctgggcaagctggagatggacttcgacttctgcgaggggaccacggtcgtggtgaccgaggactgcgagaagcggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgaccgccggccacgggcagatcgacaacttctccctgggcgtgctgggcatggccctcttcctggaggagatgctgcggacgcgcgtcgggaccaagcacgcgatcctcctggtggccctgagcttcgtgaccctcatcaccggcaacatgtccttccgggacctggggcgcgtcatggtgatggtgggcgccacgatgaccgacgacatcgggatgggcgtcacctacctggccctcctggccgcgttcaaggtgcgccccaccttcgccgccggcctgctcctgcggaagctgacgagcaaggagctcatgatggccaccatcgggatcgccctgctgtcccagagcaccctccccgagaccatcctggagctgacggacgcgctcgccctgggcatgatggccctgaagatcgtgcgcaacatggagaagtaccagctcgccgtcaccatcatggccatctcctgcgtgccgaacgcggtgatcctgcagaacgcctggaaggtcagctgcaccatcctggccgccgtgtccgtgagccccctcctgctgacctccagccagcagaaggcggactggatccccctcgccctgacgatcaaggggctgaaccccaccgccatcttcctcaccaccctgtcccggacgagcaagaagcgctcctggccgctgaacgaggccatcatggccgtcggcatggtgagcatcctcgcgtccagcctgctgaagaacgacatccccatgaccggccccctcgtcgccgggggcctgctgaccgtgtgctacgtgctcaccgggcggagcgccgacctggagctggagcgcgccgccgacgtcaagtgggaggaccaggcggagatctccggcagctcccccatcctcagcatcacgatctccgaggacgggagcatgtccatcaagaacgaggaggaggagcagaccctgaccatcctgatccggaccggcctcctggtgatcagcggcgtgttcccggtctccatccccatcaccgccgccgcctggtacctgtgggaggtgaagaagcagcgcgccggggtgctctgggacgtccccagcccgccgcccgtgggcaaggcggagctggaggacggggcctaccggatcaagcagcgcggcatcctggggtactcccagatcggcgccggcgtgtacaaggaggggacgttccacaccatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgcgctggagcccggcaagaacccccgcgccgtgcagaccaagcccgggatcttcaagacgaacaccggcaccatcggggccgtcagcctggacttctcccccggcaccagcggctcccccatcgtggaccggaaggggaaggtggtcggcctctacgggaacggcgtggtgacgcgcagcggcgcctacgtctccgcgatcgcccagaccgagaagtccatcgaggacaaccccgagatcgaggacgacatcttccggaagaagcgcctgaccatcatggacctgcaccccggggccggcaagaccaagcggtacctgcccgccatcgtgcgcgaggccatcaagcgggggctccgcacgctgatcctggcgccgacccgcgtggtcgccgccgagatggaggaggccctccggggcctgcccatccgctaccagacccccgccatccgggcggagcacaccgggcgcgagatcgtggacctgatgtgccacgccacgttcaccatgcggctcctgagccccgtgcgcgtcccgaactacaacctgatcatcatggacgaggcccacttcaccgaccccgcctccatcgccgcgcggggctacatcagcacccgcgtggagatgggcgaggccgccgggatcttcatgacggccacgccgcccggctcccgggacccgttcccccagagcaacgcgcccatcatggacgaggagcgcgagatccccgagcggtcctggaacagcgggcacgagtgggtgaccgacttcaagggcaagaccgtctggttcgtgccgtccatcaaggccgggaacgacatcgccgcctgcctccgcaagaacggcaagaaggtgatccagctgagccggaagacgttcgactccgagtacgtcaagacccgcgccaacgactgggacttcgtggtgaccaccgacatcagcgagatgggcgcgaacttcaaggccgagcgggtcatcgacccccgccggtgcatgaagcccgtgatcctgacggacggggaggagcgcgtgatcctcgccggccccatgccggtcacccactccagcgccgcccagcggcgcgggcgcatcggccggaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctacaaggtggcggccgaggggatcaactacgccgaccgcaagtggtgcttcgacggcatcaagaacaaccagatcctggaggagaacgtggaggtcgagatctggacgaaggagggggagcggaagaagctcaagccgcgctggctggacgcccggatctacagcgaccccctggcgctcaaggagttcaaggagttcgccgccggccgcaagtccctgaccctgaacctcatcaccgagatgggccggctgcccaccttcatgacgcagaaggcccgcaacgccctggacaacctcgcggtgctgcacaccgccgaggtcgggggcaaggcctacacccacgccctgagcgagctccccgagaccctggagacgctgctcctgctgaccctcctggccgcggtcaccgggggcatcttcctgttcctcatgtccggcaaggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcaccgtggtcgccgccaccatggccaacgagatgggcttcctggagaagacgaagaaggacctggggttcggcagcatcaccacccaggagagcgagtccaacatcctcgacatcgacctgcgcccggccagcgcgtggaccctgtacgccgtggccacgaccttcgtgacccccatgctccggcactccatcgagaacagctccgtcaacgtgagcctgaccgccatcgcgaaccaggccacggtgctgatgggcctcgggaagggctggcccctgtccaagatggacatcggggtccccctgctcgccatcggctgctacagccaggtgaacccgatcaccctgaccgccgccctgctcctgctggtggcgcactacgccatcatcgggcccggcctccaggccaaggccacccgcgaggcccagaagcgggcggccgccggcatcatgaagaaccccacggtcgacgggatcaccgtgatcgacctggagcccatcccgcacgaccccaagttcgagaagcagctgggccaggtgatgctcctgatcctgtgcgtcacccaggtgctcatgatgcgcaccacgtgggccctgtgcgaggccctgaccctcgcgaccgggcccatctccaccctgtgggagggcaaccccgggcggttctggaacacgaccatcgccgtgagcatggccaacatcttccgcggctcctacctggccggcgcggggctcctgttcagcatcatgaagaacaccaccaacacgcgccggggcaccgggaacgtcggcgagaccctgggcgagaagtggaagtcccgcctcaacgccctgggcaagagcgagttccagatctacaagaagtccggcatccaggaggtggaccggaccctggccaaggaggggatcaagcgcggcgagacggaccaccacgccgtgagccgggggtccgccaagctccgctggttcgtcgagcggaacatggtgaccccggagggcaaggtggtcgacctgggctgcgggcgcggcgggtggagctactactgcggcgggctgaagaacgtgcgggaggtgaagggcctcaccaagggcgggcccggccacgaggagcccatccccatgtccacctacgggtggaacctggtccgcctgcagagcggcgtggacgtgttcttcacgccgcccgagaagtgcgacaccctcctgtgcgacatcggggagagctcccccaaccccaccatcgaggcgggccggaccctgcgcgtcctcaacctggtggagaactggctgaacaacaacacccagttctgcatcaaggtgctcaacccgtacatgcccagcgtcatcgagaagatggagacgctgcagcggaagtacggcggggccctggtgcgcaaccccctgtcccggaacagcacccacgagatgtactgggtgtccaacgccaccggcaacatcgtcagctccgtgaacatgatcagccgcatgctcatcaaccggttcaccatgaagcacaagaaggccacgtacgagccggacgtggacctggggtccggcacccgcaacatcgggatcgagagcgagacccccaacctggacatcatcggcaagcggatcgagaagatcaagcaggagcacgagacctcctggcactacgaccaggaccacccctacaagacgtgggcctaccacggcagctacgagaccaagcagaccgggtccgcgagctccatggtcaacggcgtggtgcgcctcctgaccaagccctgggacgtcgtgccgatggtgacgcagatggccatgaccgacaccacccccttcgggcagcagcgcgtcttcaaggagaaggtggacacgcggacccaggagcccaaggagggcaccaagaagctgatgaagatcaccgccgagtggctctggaaggagctgggcaaggagaagacgccccgcatgtgcacccgggaggagttcacccgcaaggtgcggagcaacgccgccctgggggcggtcttcaccgacgagaacaagtggaagtccgcccgcgaggccgtggaggacggccggttctgggagctcgtggaccgcgagcggaacctgcacctggaggggaagtgcgagacgtgcgtctacaacatgatgggcaagcgcgagaagaagctcggggagttcggcaaggccaagggcagccgggcgatctggtacatgtggctgggggcccgcttcctggagttcgaggccctcggcttcctgaacgaggaccactggttctcccgggggaacagcctgagcggcgtggagggggagggcctccaccgcctgggctacatcctgcgggaggtcgggaagaaggagggcggggccatgtacgccgacgacaccgcgggctgggacacccgcatcaccctcgaggacctgaagaacgaggagatggtgacgaaccacatgaagggggagcacaagaagctggccgaggccatcttcaagctcacctaccagaacaaggtggtccgggtgcagcgcccgacgccccggggcaccgtgatggacatcatctcccgcaaggaccagcggggcagcgggcaggtcggcacgtacgggctgaacaccttcaccaacatggaggcccagctgatccgccagatggagggcgagggcatcttcaagtccatccagcacctcaccgccacggaggagaccgcggtgcagaactggctggcccgcgtggggcgggagcgcctgagccggatggccatctccggcgacgactgcgtcgtgaagcccatcgacgaccgcttcgccagcgccctcaccgcgctgaacgacatggggaaggtgcggaaggacatccagcagtgggagccctcccgcggctggaacgactggacccaggtcccgttctgcagccaccacttccacgagctggtgatgaaggacgggcgggtgctcgtcgtgccctgccgcaaccaggacgagctgatcggccgggcccgcatctcccagggcgccgggtggagcctgaaggagaccgcctgcctcggcaagtcctacgcccagatgtggacgctgatgtacttccaccggcgcgacctgcggctcgcggccaacgccatctgcagcgccgtgccctcccactgggtccccaccagccgcaccacctggtccatccacgcgaagcacgagtggatgacgaccgaggacatgctggccgtgtggaaccgggtgtggatccaggagaacccgtggatggaggacaagacccccgtcgagagctgggaggaggtgccctacctggggaagcgcgaggaccagtggtgcggctccctcatcgggctgaccagccgggccacgtgggccaagaacatccagaccgccatcaaccaggtgcgcagcctgatcggcaacgagggctacaccgactacatgccctccatgaagcggttccgccgcgaggaggaggaggcgggggtcctctggtga

SEQ ID NO: 9762 - RNA, 9876 nt, synthetic construct
  misc_feature 1..9876: note = derived and/or modified CDS sequence (opt1) from DENV-2__KX702404__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcaccaccgaggccgagctgacggggtacggcaccgtgaccatggagtgcagcccccgcaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgcgaagaagcaggacgtcgtggtcctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaaggtggtgaaggagatcgccgagacgcagcacgggaccatcgtcatccgcgtgcagtacgagggcgacggctccccctgcaagatccccttcgagatcaccgacctggagaagcggcacgtgctcgggcgcctgatcaccgtcaacccgatcgtgacggagaaggacagccccgtgaacatcgaggcggagccgcccttcggcgactcctacatcatcgtcggggtggagccgggccagctgaagctcaactggttcaagaaggggagctccatcggccagatgttcgagaccaccatgcgcggcgccaagcggatggccatcctgggggacaccgcctgggacttcggcagcctcgggggcgtgttcacgtccatcgggaaggccctccaccaggtcttcggcgcgatctacggcgccgccttcagcggggtgtcctggaccatgaagatcctgatcggcgtgatcatcacctggatcgggatgaacagccgctccaccagcctgtccgtcagcctggtgctcgtgggcgtcgtgacgctgtacctgggggccatggtgcaggcggactccggctgcgtcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgagatcaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtggtcgtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacgcgcgtgggcaccaagcacgcgatcctgctcgtcgccctgagcttcgtgaccctgatcaccgggaacatgtccttccgggacctcggccgcgtgatggtcatggtgggggccacgatgaccgacgacatcggcatgggcgtgacctacctggccctgctcgccgcgttcaaggtccgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtgaccatcatggccatctcctgcgtcccgaacgcggtgatcctccagaacgcctggaaggtgagctgcaccatcctggccgccgtctccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtggccggcgggctcctgaccgtctgctacgtgctgaccggccggagcgccgacctcgagctggagcgcgccgccgacgtgaagtgggaggaccaggcggagatctccgggagctcccccatcctgagcatcacgatctccgaggacggcagcatgtccatcaagaacgaggaggaggagcagaccctcaccatcctgatccggaccggcctgctcgtcatcagcggggtgttcccggtgtccatccccatcaccgccgccgcctggtacctgtgggaggtcaagaagcagcgcgccggcgtgctgtgggacgtgcccagcccgccgcccgtcgagaaggcggagctcgaggacggggcctaccggatcaagcagcgcggcatcctggggtactcccagatcggcgccggcgtgtacaaggaggggacgttccacaccatgtggcacgtgacccggggcgccgtcctgatgcaccgcgggaagcggatcgagcccagctgggccgacgtgaagaaggacctcatctcctacggcgggggctggaagctggagggcgagtggaaggagggggaggaggtgcaggtcctggcgctcgagcccggcaagaacccccgcgccgtgcagaccaagcccgggatcttcaagacgaacaccggcaccatcggggccgtgagcctggacttctcccccggcaccagcggctcccccatcgtcgaccggaaggggaaggtggtgggcctgtacgggaacggcgtcgtgacgcgcagcggcgcctacgtgtccgcgatcgcccagaccgagaagtccatcgaggacaaccccgagatcgaggacgacatcttccggaagaagcgcctcaccatcatggacctgcaccccggggccggcaagaccaagcggtacctgcccgccatcgtccgcgaggccatcaagcgggggctgcgcacgctcatcctggcgccgacccgcgtggtggccgccgagatggaggaggccctgcggggcctccccatccgctaccagacccccgccatccgggcggagcacaccgggcgcgagatcgtcgacctgatgtgccacgccacgttcaccatgcggctgctcagccccgtgcgcgtgccgaactacaacctgatcatcatggacgaggcccacttcaccgaccccgcctccatcgccgcgcggggctacatcagcacccgcgtcgagatgggcgaggccgccgggatcttcatgacggccacgccgcccggctcccgggacccgttcccccagagcaacgcgcccatcatggacgaggagcgcgagatccccgagcggtcctggaacagcgggcacgagtgggtgaccgacttcaagggcaagaccgtgtggttcgtcccgtccatcaaggccgggaacgacatcgccgcctgcctgcgcaagaacggcaagaaggtgatccagctcagccggaagacgttcgactccgagtacgtgaagacccgcgccaacgactgggacttcgtcgtgaccaccgacatcagcgagatgggcgcgaacttcaaggccgagcgggtgatcgacccccgccggtgcatgaagcccgtcatcctgacggacggggaggagcgcgtgatcctggccggccccatgccggtgacccactccagcgccgcccagcggcgcgggcgcatcggccggaaccccaagaacgagaacgaccagtacatctacatgggggagcccctcgagaacgacgaggactgcgcgcactggaaggaggccaagatgctgctggacaacatcaacacccccgagggcatcatcccgtccatgttcgagcccgagcgcgagaaggtcgacgccatcgacggcgagtaccggctccgcggggaggcccggaagaccttcgtggacctgatgcgccggggcgacctgcccgtgtggctcgcctacaaggtcgcggccgaggggatcaactacgccgaccgcaagtggtgcttcgacggcatcaagaacaaccagatcctggaggagaacgtggaggtggagatctggacgaaggagggggagcggaagaagctgaagccgcgctggctcgacgcccggatctacagcgaccccctggcgctgaaggagttcaaggagttcgccgccggccgcaagtccctcaccctgaacctgatcaccgagatgggccggctccccaccttcatgacgcagaaggcccgcaacgccctggacaacctggcggtcctccacaccgccgaggtcgggggcaaggcctacacccacgccctgagcgagctgcccgagaccctcgagacgctgctgctcctgaccctgctcgccgcggtcaccgggggcatcttcctgttcctgatgtccggcaaggggatcggcaagatgaccctcgggatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtggtcatcgcgatcctgaccgtggtggccgccaccatggccaacgagatgggcttcctcgagaagacgaagaaggacctggggttcggcagcatcaccacccaggagagcgagtccaacatcctggacatcgacctccgcccggccagcgcgtggaccctgtacgccgtcgccacgaccttcgtgacccccatgctgcggcactccatcgagaacagctccgtgaacgtcagcctcaccgccatcgcgaaccaggccacggtgctgatgggcctggggaagggctggcccctctccaagatggacatcggggtgcccctgctggccatcggctgctacagccaggtcaacccgatcaccctcaccgccgccctgctgctcctggtggcgcactacgccatcatcgggcccggcctgcaggccaaggccacccgcgaggcccagaagcgggcggccgccggcatcatgaagaaccccacggtggacgggatcaccgtcatcgacctcgagcccatcccgtacgaccccaagttcgagaagcagctgggccaggtgatgctgctcatcctgtgcgtgacccaggtcctgatgatgcgcaccacgtgggccctctgcgaggccctgaccctggcgaccgggcccatctccaccctctgggagggcaaccccgggcggttctggaacacgaccatcgccgtgagcatggccaacatcttccgcggctcctacctggccggcgcggggctcctgttcagcatcatgaagaacaccaccaacacgcgccggggcaccgggaacgtgggcgagaccctgggcgagaagtggaagtcccgcctgaacgccctcggcaagagcgagttccagatctacaagaagtccggcatccaggaggtcgaccggaccctggccaaggaggggatcaagcgcggcgagacggaccaccacgccgtgagccgggggtccgccaagctgcgctggttcgtggagcggaacatggtcaccccggagggcaaggtggtggacctcggctgcgggcgcggcgggtggagctactactgcggcgggctgaagaacgtccgggaggtgaagggcctgaccaagggcgggcccggccacgaggagcccatccccatgtccacctacgggtggaacctcgtgcgcctgcagagcggcgtcgacgtgttcttcacgccgcccgagaagtgcgacaccctgctctgcgacatcggggagagctcccccaaccccaccatcgaggcgggccggaccctgcgcgtgctgaacctcgtcgagaactggctgaacaacaacacccagttctgcatcaaggtgctgaacccgtacatgcccagcgtgatcgagaagatggagacgctccagcggaagtacggcggggccctggtccgcaaccccctgtcccggaacagcacccacgagatgtactgggtgtccaacgccaccggcaacatcgtgagctccgtcaacatgatcagccgcatgctgatcaaccggttcaccatgaagcacaagaaggccacgtacgagccggacgtggacctcgggtccggcacccgcaacatcgggatcgagagcgagatccccaacctggacatcgtgggcaagcggatcgagaagatcaagcaggagcacgagacctcctggcactacgaccaggaccacccctacaagacctgggcctaccacggcagctacgagacgaagcagaccgggtccgcgagctccatggtcaacggcgtggtgcgcctgctcaccaagccctgggacgtcgtgccgatggtgacccagatggccatgacggacaccacccccttcgggcagcagcgcgtcttcaaggagaaggtggacacccggacgcaggagcccaaggagggcaccaagaagctgatgaagatcaccgccgagtggctgtggaaggagctcggcaaggagaagacgccccgcatgtgcacgcgggaggagttcacccgcaaggtgcggagcaacgccgccctgggggcggtcttcaccaacgagaacaagtggaagtccgcccgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggcgatctggtacatgtggctcggggcccgcttcctggagttcgaggccctgggcttcctcaacgaggaccactggttctcccgggggaacagcctgagcggcgtggagggggagggcctgcaccgcctcggctacatcctgcgggaggtcgggaagaaggagggcggggccatgtacgccgacgacacggcgggctgggacacccgcatcaccctggaggacctcaagaacgaggagatggtgaccaaccacatgaagggggagcacaagaagctggccgaggccatcttcaagctgacgtaccagaacaaggtggtccgggtgcagcgcccgacgccccggggcaccgtgatggacatcatctcccgcaaggaccagcggggcagcgggcaggtcggcacctacgggctcaacacgttcaccaacatggaggcccagctgatccgccagatggagggcgagggcatcttcaagtccatccagcacctgaccgccaccgaggagatcgcggtgcagaactggctcgcccgcgtggggcgggagcgcctgagccggatggccatctccggcgacgactgcgtcgtgaagcccatcgacgaccgcttcgccagcgccctgacggcgctcaacgacatggggaaggtgcggaaggacatccagcagtgggagccctcccgcggctggaacgactggacccaggtcccgttctgcagccaccacttccacgagctggtgatgaaggacgggcgggtgctggtcgtgccctgccgcaaccaggacgagctcatcggccgggcccgcatctcccagggcgccgggtggagcctgaaggagaccgcctgcctgggcaagtcctacgcccagatgtggaccctcatgtacttccaccggcgcgacctgcggctggcggccaacgccatctgcagcgccgtgccctcccactgggtccccaccagccgcacgacctggtccatccacgcgaagcacgagtggatgaccaccgaggacatgctcgccgtgtggaaccgggtgtggatccaggagaacccgtggatggaggacaagacgcccgtcgagagctgggaggaggtgccctacctggggaagcgcgaggaccagtggtgcggctccctgatcgggctcaccagccgggccacctgggccaagaacatccagaccgccatcaaccaggtgcgcagcctgatcggcaacgagggctacacggactacatgccctccatgaagcggttccgccgcgaggaggaggaggcgggggtcctgtggtga

SEQ ID NO: 9763 - RNA, 9873 nt, synthetic construct
  misc_feature 1..9873: note = derived and/or modified CDS sequence (opt1) from DENV-2__JQ686088__SS-prME
  source 1..9873: mol_type = other RNA
accaccggcatgatcatcatgctgatccccaccgtgatggcgttccacctcaccacccggaacggggagccccacatgatcgtgtcccggcaggacaagggcaagtccctgctgttcaagaccaaggacgggaccaacatgtgcaccctcatggcgatggacctgggcgagctgtgcgaggacaccatcacctacaagtgccccttcctcaagcagaacgagcccgaggacatcgactgctggtgcaacagcacgtccacctgggtgacctacgggacctgcacgaccaccggcgagcaccgccgggagaagcgcagcgtggcgctggtgccccacgtgggcatggggctggagacccggacggagacctggatgtccagcgagggcgcctggaagcacgcccagcgcatcgagacctggatcctccggcacccggggttcaccatcatggccgccatcctggcgtacacgatcggcaccacccacttccagcgcgtgctgatcttcatcctcctgaccgccgtcgccccctccatgacgatgcggtgcatcgggatcgccaaccgcgacttcgtggagggcgtgagcggcgggtcctgggtcgacatcgtgctggagcacggcagctgcgtgaccaccatggcgaagaacaagcccaccctcgacttcgagctgatcaagacggaggccaagcagcccgccaccctgcggaagtactgcatcgaggccaagctcaccaacaccacgaccgactcccgctgccccacccagggggagcccagcctgaacgaggagcaggacaagcggttcgtctgcaagcactccatggtggaccgcggctggggcaacgggtgcggcctgttcgggaagggcgggatcgtgacctgcgccatgttcacgtgcaagaagaacatgaagggcaagatcgtccagcccgagaacctcgagtacaccatcgtgatcacgccccacagcggcgaggagcacgcggtggggaacgacaccggcaagcacgggaaggaggtcaagatcaccccgcagtccagcatcacggaggccgagctgaccggctacgggaccgtgaccatggagtgcagcccccggacgggcctggacttcaacgagatggtgctcctgcagatggaggacaaggcctggctggtccaccgccagtggttcctcgacctgcccctgccctggctcccgggcgccgacacccaggggagcaactggatccagaaggagaccctggtgaccttcaagaacccccacgccaagaagcaggacgtggtcgtgctgggctcccaggagggggcgatgcacacggccctcaccggcgccaccgagatccagatgagcagcgggaacctgctgttcaccggccacctcaagtgccggctgcgcatggacaagctgcagctcaagggcatgtcctacagcatgtgcacggggaagttcaaggtcgtgaaggagatcgccgagacccagcacggcaccatcgtgatccgggtccagtacgagggggacggctccccctgcaagatccccttcgagatcatggacctggagaagcgccacgtgctgggccggctcatcaccgtgaacccgatcgtcacggagaaggaccgccccgtgaacatcgaggccgagccgcccttcggggacagctacatcatcatcggcgtggagccggggcagctgaagctgaactggttcaagaagggctccagcatcgggcagatgttcgagaccaccatgcgcggcgcgaagcggatggccatcctcggcgacaccgcctgggacttcgggtccctgggcggggtcttcacgagcatcggcaaggccctgcaccaggtgttcggggccatctacggcgcggccttctccggcgtgagctggaccatgaagatcctcatcggggtcatcatcacctggatcggcatgaactcccgcagcacctccctgagcgtgtccctggtgctggtcgggatcgtgacgctctacctgggcgtgatggtccaggccgacagcgggtgcgtggtgtcctggaagaacaaggagctgaagtgcggcaacggcatcttcgtcaccgacaacgtgcacacctggaccgagcagtacaagttccagcccgagagcccctccaagctcgccagcgcgatccagaaggcccacgaggaggggatctgcggcatccggagcgtgacgcgcctggagaacctgatgtggaagcagatcacccccgagctcaaccacatcctgtccgagaacgaggtcaagctgaccatcatgaccggggacatcaagggcatcatgcaggtcgggaagcggagcctccagccgcagcccacggagctgcgctactcctggaagacctggggcaaggccaagatgctgagcaccgagctccacaaccagaccttcctgatcgacggccccgagacggccgagtgcccgaacaccaaccgggcctggaactccctggaggtggaggactacgggttcggcgtcttcaccaccaacatctggctcaagctgcgcgagaagcaggacgtgttctgcgacagcaagctgatgtccgcggccatcaaggacaaccgggccgtgcacgccgacatggggtactggatcgagagcgccctcaacgacacctggaagatcgagaaggcgtccttcatcgaggtcaagagctgccactggcccaagtcccacacgctgtggagcaacggcgtgctggagtccgagatgatcatccccaagaacctcgccggccccgtgagccagcacaacaaccgcccggggtactacacccagaccgccggcccctggcacctggggaagctggagatggacttcgacttctgcaagggcaccacggtcgtggtgaccgaggactgcgggaaccggggcccctccctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgaccgccggccacgggcagatcgacaacttcagcctgggcatcctgggcatggccctcttcctggaggagatgctgcggacgcgcgtggggaccaagcacgccatcctcctggtcgccgtgtccttcgtgaccctgatcaccggcaacatgagcttccgggacctcgggcgcgtcatcgtgatggtgggcgccacgatgaccgacgacatcgggatgggcgtcacctacctggcgctgctcgccgccttcaaggtgcgccccaccttcgccgccggcctgctgctccggaagctgacgtccaaggagctgatgatgaccaccatcgggatcgtgctcctgagccagtccagcatccccgagaccatcctggagctcacggacgcgctggccctgggcatgatgatcctcaagatggtccgcaacatggagaagtaccagctggccgtgaccatcatggccatcctgtgcgtgccgaacgccgtcatcctccagaacgcgtggaaggtgtcctgcaccatcctggccgtcgtgagcgtgagccccctgctcctgaccagctcccagcagaaggccgactggatccccatcgccctgacgatcaaggggctcaaccccaccgccatcttcctgaccaccctgagccggacgtccaagaagcgcagctggccgctcaacgaggcgatcatggccgtcggcatggtgtccatcctggccagctccctgctcaagaacgacatccccatgaccggccccctggtggccgggggcctgctcaccgtctgctacgtgctgaccgggcggagcgcggacctggagctcgagcgcgccgccgacgtgaagtgggaggaccaggccgagatctccggcagcagccccatcctgtccatcacgatcagcgaggacgggtccatgagcatcaagaacgaggaggaggagcagaccctgaccatcctcatccggaccggcctgctggtcgtgtccggcctcttcccggtgagcgtccccatcaccgccgcggcctggtacctgtgggaggtgaagaagcagcgcgccggggtgctgtgggacgtccccagcccgccgcccgccggcaaggccgagctcgaggacggggcgtaccggatcaagcagaagggcatcctggggtacagccagatcggcgccggcgtgtacaaggaggggacgttccacaccatgtggcacgtgacccgcggcgccgtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccccgcgcggtgcagaccaagcccgggctgttcaagacgaacaccggcaccatcggggccgtgtccctggacttcagccccggcacctccggcagccccatcgtcgacaagaaggggaaggtggtgggcctctacgggaacggcgtcgtgacgcggtccggcgcctacgtgagcgccatcgcccagaccgagaagtccatcgaggacaaccccgagatcgaggacgacatcttccgcaagcggcgcctgaccatcatggacctgcaccccggggcgggcaagaccaagcggtacctgcccgccatcgtccgcgaggccatcaagcgggggctccgcacgctgatcctggccccgacccgggtggtggcggccgagatggaggaggccctccgcggcctgcccgtccgctaccagacccccgccatccgggccgagcacaccgggcgcgagatcgtggacctgatgtgccacgcgacgttcaccatgcggctcctgagccccatccgcgtgccgaactacaacctgatcatcatggacgaggcccacttcaccgaccccgcctccatcgccgcccggggctacatcagcacccgcgtcgagatgggcgaggcggccgggatcttcatgacggccacgccgcccggcagccgggacccgttcccccagtccaacgcccccatcatggacgaggagcgcgagatccccgagcggagctggaactccgggcacgagtgggtgaccgacttcaagggcaagaccgtgtggttcgtcccgagcatcaagacggggaacgacatcgccgcgtgcctccgcaagaacggcaagcgggtgatccagctgtcccgcaagaccttcgacagcgagtacatcaagacccggaccaacgactgggacttcgtggtcacgaccgacatctccgagatgggcgccaacttcaaggcccagcgcgtgatcgacccccggcgctgcatgaagcccgtgatcctgaccgacggggaggagcgggtcatcctcgccggccccatgccggtgacccacagctccgcggcccagcgcgggcgggtgggccgcaaccccaagaacgagaacgaccagtacatctacatgggggagcccctggagaacgacgaggactgcgcccactggaaggaggccaagatgctgctcgacaacatcaacacgcccgagggcatcatcccgagcatgttcgagcccgagcgcgagaaggtcgacgccatcgacggcgagtaccggctgcgcggggaggcgcggaagaccttcgtggacctgatgcgccggggcgacctccccgtgtggctggcctacaaggtcgccgccgaggggatcaactacgccgaccgccggtggtgcttcgacggcacccgcaacaaccagatcctggaggagaacgtggaggtcgagatctggaccaaggagggggagcggaagaagctcaagccgcgctggctggacgcgcggatctacgccgaccccctggccctcaaggagttcaaggagttcgccgccggccgcaagtccctgacgctgaacctcatcaccgagatgggccggctgcccaccttcatgacccagaaggtgcgcgacgcgctggacaacctcgccgtgctgcacacggccgaggccgggggcaaggcgtacaaccacgccctgaacgagctccccgagaccctggagaccctgctcctgctgaccctcctggccaccgtcaccggcgggatcttcctgttcctcatgagcgggcgggggatcggcaagatgaccctggggatgtgctgcatcatcaccgcctccatcctgctctggtacgcccagatccagccgcactggatcgcggccagcatcatcctggagttcttcctgatcgtgctcctgatccccgagcccgagaagcagcgcacgccccaggacaaccagctgacgtacgtggtcatcgccatcctcaccgtggtggccgccaccatggcgaacgagatgggcttcctggagaagaccaagaaggacctggggctcggctccatcgtcacgcagcagccggagagcaacatcctggacatcgacctgcggcccgcctccgcctggaccctctacgccgtggccaccaccttcatcacgcccatgctgcgccacagcatcgagaactccagcgtgaacgtcagcctgaccgcgatcgccaaccaggccaccgtgctcatgggcctggggaagggctggcccctgtccaagatggacatcggggtgccgctcctggccatcggctgctacagccaggtcaaccccatcaccctgacggccgccctcttcctgctggtggcccactacgccatcatcgggcccggcctccaggccaaggcgacccgggaggcccagaagcgcgccgccgccggcatcatgaagaaccccaccgtggacgggatcaccgtcatcgacctggacccgatcccctacgaccccaagttcgagaagcagctgggccaggtgatgctcctggtgctgtgcgtcacgcaggtcctcatgatgcggaccacctgggcgctgtgcgaggccctgaccctcgccacggggcccgtgtccaccctgtgggagggcaacccggggcgcttctggaacaccaccatcgccgtcagcatggccaacatcttccgcggctcctacctggcgggcgccgggctcctgttcagcatcatgaagaacacgacctccgcccggcgcggcaccgggaacatcggcgagaccctgggcgagaagtggaagtcccggctcaacgccctggggaagtccgagttccagatctacaagaagtccggcatccaggaggtggaccgcacgctggccaaggaggggatcaagcggggcgagaccgaccaccacgcggtgtcccgcgggagcgccaagctccggtggttcgtcgagcgcaacctggtgacccccgagggcaaggtggtcgacctgggctgcgggcggggcgggtggtcctactactgcggcgggctcaagaacgtgcgcgaggtgaagggcctgaccaagggcgggcccggccacgaggagcccatcccgatgagcacgtacgggtggaacctggtccggctccagtccggcgtggacgtgttcttcatcccgcccgagcgctgcgacaccctgctgtgcgacatcggggagagctcccccagcccgaccgtcgaggccggccggaccctccgcgtgctgaacctggtggagaactggctctccaacaacacccagttctgcgtcaaggtgctgaacccctacatgcccagcgtgatcgagaagatggaggccctgcagcggaagcacggcggggcgctggtccgcaacccgctcagccggaactccacgcacgagatgtactgggtgagcaacgcctccggcaacatcgtgagctccgtcaacatgatcagccgcatgctgatcaaccggttcaccatgcgccacaagaaggccacctacgagcccgacgtggacctggggtccggcacccgcaacatcgggatcgagagcgagacgcccaacctcgacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctgaccaagccgtgggacgtggtccccatggtgacccagatggcgatgaccgacacgacccccttcgggcagcagcgggtcttcaaggagaaggtggacacccgcacccaggagcccaaggagggcacgaagaagctcatgcggatcaccgccgagtggctgtggaaggagctgggcaagaagaagaccccgcgcatgtgcacccgggaggagttcacgaagaaggtgcgcagcaacgccgccctcggggccatcttcaccgacgagaacaagtggaagtccgcgcgggaggccgtcggcgacgggcgcttctgggagctggtggacaaggagcggaacctgcacctcgagggcaagtgcgagacctgcgtgtacaacatgatggggaagcgcgagaagaagctgggcgagttcggcaaggccaaggggagccgggccatctggtacatgtggctgggcgcccgcttcctcgagttcgaggcgctggggttcctgaacgaggaccactggttctcccgggagaacagcctctccggcgtcgagggggagggcctgcacaagctgggctacatcctccgcgaggtgagcaagaaggagggcggcgccatgtacgccgacgacaccgccgggtgggacacgcggatcaccatcgaggacctgaagaacgaggagatgatcaccaaccacatggagggcgagcacaagaagctggcggaggccatcttccgcctcacctaccagaacaaggtggtccgggtgcagcgccccacgccccgggggaccgtgatggacatcatcagccgccgcgaccagcggggctccggccaggtcgggacctacggcctgaacaccttcacgaacatggaggcccagctgatccgccagatggagggggagggcgtgttcaagagcatccagcacctcaccgccgccgaggagatcgcggtgcagaactggctggtccgggtgggccgcgagcggctgtcccgcatggccatcagcggggacgactgcgtggtcaagcccctcgacgaccggttcgcccgcgccctgaccgccctgaacgacatgggcaaggtgcggaaggacatccagcagtgggagccgtcccgcgggtggaacgactggacccaggtgcccttctgcagccaccacttccacgagctcatcatgaaggacggccggatcctggtcgtgccctgccgcaaccaggacgagctgatcgggcgggcgcgcatctcccagggcgccggctggagcctccgggagacggcctgcctggggaagtcctacgcccagatgtggagcctgatgtacttccaccgccgggacctccgcctggccgcgaacgccatctgctccgccgtgcccagccactgggtcccgacctcccggaccacctggagcatccacgcctcccacgagtggatgaccacggaggacatgctgaccgtgtggaaccgcgtgtggatccaggagaacccctggatggaggacaagacccccgtcgagagctgggaggagatcccctacctcggcaagcgcgaggaccagtggtgcgggtccctgatcggcctgaccagccgggccacgtgggcgaagaacatccagaccgccatcaaccaggtgcgcagcctcatcgggaacgaggagtacaccgactacatgccgtccatgaagcggttccgccgggaggaggaggaggccggcgtgctgtggtga

SEQ ID NO: 9764 - RNA, 9876 nt, synthetic construct
  misc_feature 1..9876: note = derived and/or modified CDS sequence (opt1) from DENV-2__KF479233__SS-prME
  source 1..9876: mol_type = other RNA
accgccggggtgatcatcatgctgatccccaccgccatggcgttccacctcaccacccggaacggggagccccacatgatcgtcagccggcaggagaagggcaagagcctgctgttcaagaccgaggacggggtgaacatgtgcaccctcatggccatggacctgggggagctgtgcgaggacaccatcacctacaactgccccctcctgcgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctcgagacccgcaccgagacctggatgtccagcgagggcgcctggaagcacgcgcagcggatcgagacctggatcctgcgccaccccgggttcacgatcatggccgccatcctggcctacaccatcggcaccacctacttccagcgggtcctcatcttcatcctgctgacggcggtggccccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggcgaagctgaccaacacgaccaccgccagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctcgacttcaacgagatggtgctgctgcagatggagaacaaggcgtggctcgtgcaccggcagtggttcctggacctgcccctcccctggctgccgggcgccgacacccaggggtccaactggatccagaaggagaccctggtcacgttcaagaacccccacgccaagaagcaggacgtggtcgtgctcggcagccaggagggggccatgcacaccgccctgaccggcgcgaccgagatccagatgagctccgggaacctcctgttcacgggccacctgaagtgccgcctgcggatggacaagctccagctgaagggcatgagctactccatgtgcaccgggaagttcaaggtggtcaaggagatcgccgagacccagcacggcaccatcgtggtgcgcgtccagtacgagggggacggcagcccctgcaagatccccttcgagatcatggacctggagaagcggcacgtgctcggccgcctgatcacggtgaacccgatcgtcaccgagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggccatcctgggcgacacggcgtgggacttcgggagcctgggcggggtcttcacctccatcggcaaggccctccaccaggtgttcggggccatctacggcgccgcgttcagcggcgtgtcctggaccatgaagatcctgatcggggtcgtgatcacctggatcggcatgaacagccgctccacgagcctgtccgtgagcctggtcctcgtgggggtggtcaccctgtacctgggcgtgatggtgcaggccgactccgggtgcgtcgtgagctggaagaacaaggagctcaagtgcggcagcggcatcttcatcaccgacaacgtgcacacctggacggagcagtacaagttccagcccgagtcccccagcaagctggcctccgccatccagaaggcccacgaggaggggatctgcggcatccggagcgtcacccgcctggagaacctcatgtggaagcagatcacccccgagctgaaccacatcctgtccgagaacgaggtgaagctcaccatcatgacgggggacatcaagggcatcatgcaggcggggaagcggagcctgcgcccgcagcccaccgagctgaagtactcctggaagacctggggcaaggccaagatgctcagcaccgagccccagaaccagacgttcctgatcgacggcccggagaccgccgagtgccccaacaccaaccgggcctggaactccctggaggtggaggactacgggttcggcgtcttcaccacgaacatctggctcaagctgaaggagcgccaggacgtgttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggcccggtgagccagcacaactaccgccccgggtaccacacccagaccgccggcccctggcacctcgggaagctggagatggacttcgacttctgcgagggcacgaccgtcgtggtgaccgaggactgcgggaaccggggccccagcctgcgcaccacgaccgcctccggcaagctcatcaccgagtggtgctgccggagctgcaccctgccgcccctgcgctacaagggggaggacggctgctggtacgggatggagatccggcccctcaaggagaaggaggagaacctggtcaactccctggtgacggccggccacgggcagatcgacaacttcagcctcggcgtgctgggcatggcgctgttcctcgaggagatgctgcgcacccgggtcgggaccaagcacgccgtgctgctcgtggccgtctccttcatgaccctgatcacgggcaacatgagcttccgcgacctggggcgggtgatggtgatggtcggcgccgccatgaccgacgacatcgggatgggcgtgacctacctcgcgctgctggccgccttcaaggtgcgccccaccttcgccgccggcctcctgctgcgcaagctcacgtccaaggagctgatgatgaccaccatcgggatcgtcctgctcagccagtccaccatcccggagacgatcctggagctgaccgacgcgctcgccctgggcatgatgatcctgaagatcgtgcggaacatggagaagtaccagctcgccgtcaccatcatggccatcctgtgcgtgcccaacgccgtgatcctgcagaacgcgtggaaggtcagctgcaccatcctcgccgtggtgtccgtcagccccctgctgctcacgtccagccagcagaaggccgactggatccccctggccctgaccatcaaggggctcaacccgaccgcgatcttcctgaccacgctgtcccgcaccaacaagaagcggagctggcccctcaacgaggccatcatggccgtgggcatggtgtccatcctggccagctccctgctcaagaacgacatccccatgaccggccccctggtcgccgggggcctgctcaccgtgtgctacgtgctgacggggcgcagcgcggacctggagctcgagcgggccgccgacgtccgctgggaggaccaggccgagatcagcggctccagcccgatcctgtccatcaccatcagcgaggacgggtccatgagcatcaagaacgaggaggaggagcagaccctgaccatcctcatccggacgggcctgctggtgatctccggcctcttccccgtgagcatccccatcaccgccgcggcctggtacctgtgggaggtcaagaagcagcgcgccggggtgctgtgggacgtgccctccccgccgcccgtcggcaaggccgagctcgaggacggggcctaccggatcaagcagaagggcatcctggggtacagccagatcggcgcgggcgtgtacaaggaggggaccttccacaccatgtggcacgtgacccgcggcgccgtcctgatgcacaaggggaagcggatcgagccgtcctgggccgacgtgcgcaaggacctcatcagctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggcggtgtccctggacttcagcccgggcacgtccggcagccccatcgtcgacaagaaggggaaggtggtgggcctctacgggaacggcgtcgtgacccgctccggcacctacgtgagcgccatcgcccagaccgagaagtccatcgaggacaaccccgagatcgaggacgacatcttccggaagaagcgcctgacgatcatggacctgcaccccggggccggcaagaccaagcggtacctgccggcgatcgtccgcgaggccatcaagcgggggctccgcaccctgatcctggcccccacccgggtggtggccgccgagatggaggaggcgctccgcggcctgcccatccgctaccagacgcccgccatccgggccgagcacaccgggcgcgagatcgtcgacctgatgtgccacgccaccttcaccatgcggctcctgagcccggtgcgcgtgcccaactacaacctgatcatcatggacgaggcccacttcacggaccccgcgagcatcgccgcccggggctacatctccacccgcgtcgagatgggcgaggccgccgggatcttcatgaccgcgacgccgcccggcagccgggaccccttcccccagtccaacgcccccatcatggacgaggagcgcgagatccccgagcggagctggaactccgggcacgagtgggtgacggacttcaagggcaagaccgtgtggttcgtccccagcatcaaggccgggaacgacatcgccgcgtgcctccgcaagaacggcaagaaggtgatccagctgtcccggaagaccttcgacagcgagtacatcaagacccgcacgaacgactgggacttcgtggtcaccaccgacatctccgagatgggcgccaacttcaaggccgagcgggtgatcgacccccgccggtgcatgaagcccgtgatcctgaccgacggggaggagcgcgtcatcctcgccggcccgatgcccgtgacgcacagctccgccgcgcagcggcgcgggcggatcggccgcaaccccaagaacgagaacgaccagtacatctacatgggggagcccctggagaacgacgaggactgcgcccactggaaggaggccaagatgctgctcgacaacatcaacaccccggagggcatcatccccagcatgttcgagcccgagcgcgagaaggtggacgccatcgacggcgagtaccggctgcgcggggaggcccggaagaccttcgtcgagctgatgcgccggggcgacctcccggtgtggctggcgtaccgcgtcgccgccgaggggatcaactacgccgaccggcgctggtgcttcgacggcatcaagaacaaccagatcctggaggagaacgtggaggtggagatctggaccaaggagggggagaagaagaagctcaagccccggtggctggacgcccgcatctactccgaccccctggcgctcaaggagttcaaggagttcgccgccggccgcaagagcctgacgatgaacctgatcaccgagatgggccgcctccccaccttcatgacccagaaggcccggaacgcgctggacaacctggccgtcctccacacggccgaggccgggggccgcgcctacaaccacgcgctgtccgagctgccggagaccctcgagaccctgctgctcctgaccctgctcgccacggtgaccgggggcatcttcctgttcctgatgagcggcaaggggatcggcaagatgaccctcgggatgtgctgcatcatcaccgcctccatcctgctgtggtacgcccagatccagccccactggatcgccgcgagcatcatcctcgagttcttcctgatcgtgctgctcatccccgagcccgagaagcagcggaccccgcaggacaaccagctgacgtacgtcgtgatcgccatcctgaccgtggtcgccgccaccatggccaacgagatgggcttcctcgagaagaccaagaaggacttcgggctgggctccatcgtgacgcagcagcccgagagcaacatcctggacatcgacctccgccccgcgagcgcctggaccctgtacgccgtggccaccaccttcatcacgcccatgctgcggcactccatcgagaacagctccgtcaacgtgagcctcaccgccatcgcgaaccaggccaccgtgctgatgggcctggggaagggctggccgctctccaagatggacatcggggtccccctgctggccatcggctgctacagccaggtgaaccccatcaccctcacggccgcgctgctgctcctggtggcccactacgccatcatcgggcccggcctgcaggccaaggccacccgcgaggcgcagaagcgggccgccgccggcatcatgaagaacccgaccgtcgacgggatcaccgtgatcgacctcgaccccatcccctacgaccccaagttcgagaagcagctgggccaggtgatgctgctcgtcctgtgcgtgacccaggtgctgatgatgcgcaccacctgggccctctgcgaggcgctgaccctggccacggggccgatctccaccctctgggagggcaaccccgggcggttctggaacaccaccatcgccgtcagcatggccaacatcttccgcggctcctacctggccggcgcggggctcctgttcagcatcatgaagaacacggccaacacccgccggggcaccgggaacaccggcgagacgctgggcgagaagtggaagaaccgcctgaactccctcggcaagagcgagttccagatctacaagcggtccggcatccaggaggtggaccgcaccctggccaaggaggggatcaagcggggcgagaccgaccaccacgccgtgagccgcgggtccgcgaagctgcggtggttcgtcgagcgcaacctcgtgacccccgagggcaaggtgatggacctgggctgcgggcggggcgggtggagctactactgcggcgggctgaagaacgtccgcgaggtgaagggcctcacgaagggcgggcccggccacgaggagccgatccccatgtccacctacgggtggaacctggtgcggctgcagagcggcgtcgacgtgttcttcacgccgcccgagaagtgcgacaccctcctgtgcgacatcggggagtccagcccgaaccccacggtggaggccggccgcaccctgcgggtcctcaacctggtggagaactggctgaacaacaacacccagttctgcatcaaggtgctcaacccctacatgccgagcgtcatcgagaagatggagaccctgcagcgcaagtacggcggggccctggtgcggaaccccctgtcccgcaacagcacccacgagatgtactgggtgtccaacgccagcggcaacatcgtctccagcgtgaacatgatctcccggatgctcatcaaccgcttcacgatgcggcacaagaaggccacctacgagcccgacgtggacctggggagcggcacccgcaacatcgggatcgagtccgagatccccaacctggacatcatcggcaagcgcatcgagaagatcaagcaggagcacgagaccagctggcactacgaccaggaccacccgtacaagacgtgggcgtaccacggctcctacgagaccaagcagaccgggagcgcctccagcatggtcaacggcgtggtgcggctcctgaccaagccctgggacgtcatccccatggtgacgcagatggccatgaccgacaccacccccttcgggcagcagcgcgtgttcaaggagaaggtcgacacgcggacccaggagccgaaggagggcaccaagaagctgatgaagatcaccgccgagtggctctggaaggagctgggcaagaagaagacgccccgcatgtgcacccgggaggagttcacccgcaaggtgcggtccaacgccgcgctgggggccatcttcaccgacgagaacaagtggaagtccgcccgcgaggccgtcgaggactcccggttctgggagctcgtggacaaggagcgcaacctgcacctggagggcaagtgcgagacgtgcgtgtacaacatgatggggaagcgggagaagaagatcggcgagttcgggaaggccaagggcagccgcgcgatctggtacatgtggctcggcgcccggttcctggagttcgaggccctggggttcctcaacgaggaccactggttctcccgcgagaacagcctgagcggcgtcgagggggagggcctgcacaagctcgggtacatcctgcgggaggtgtccaagaaggagggcggcgccatgtacgcggacgacaccgccgggtgggacacccgcatcaccctggaggacctcaagaacgaggagatggtgacgaaccacatggagggcgagcacaagaagctggccgaggccatcttcaagctgacctaccagaacaaggtcgtgcgggtgcagcgccccacgccccgggggaccgtcatggacatcatcagccgccgggaccagcgcggctccggccaggtgggcacgtacggcctcaacaccttcaccaacatgggggcccagctgatccgccagatggagggcgagggggtgttcaagagcatccagcacctgaccacgaccgaggaggtcgcggtgcaggactggctcgcccgggtgggccgcgagcggctgtcccgcatggccatcagcggcgacgactgcgtcgtgaagccgctggacgaccggttcgcctccgccctcaccgcgctgaacgacatggggaaggtgcgcaaggacatccagcagtgggagcccagccggggctggaacgactggacccaggtccccttctgctcccaccacttccacgagctgatcatgaaggacgggcgcgtgctcgtggtcccctgccggaaccaggacgagctgatcggccgcgcccggatcagccagggggccggctggtccctgcgcgagacggcctgcctcggcaagagctacgcccagatgtggtccctgatgtacttccaccggcgcgacctgcggctcgcggccaacgccatctgcagcgccgtgccgtcccactgggtgcccaccagccgcaccacctggtccatccacgcccggcacgagtggatgaccacggaggacatgctgaccgtctggaaccgcgtgtggatccaggagaacccctggatggaggacaagacccccgtggagagctgggaggagatcccgtacctggggaagcgggaggaccagtggtgcggcagcctcatcgggctgacctcccgcgcgacgtgggccaagaacatccagaccgccatcaaccaggtccgcagcctgatcggctccgaggagtacaccgactacatgcccagcatgaagcggttccgccgggaggaggaggaggccggggtgctctggtga

SEQ ID NO: 9765 - RNA, 9876 nt, synthetic construct
  misc_feature 1..9876: note = derived and/or modified CDS sequence (opt1) from DENV-2__KX372564__SS-prME
  source 1..9876: mol_type = other RNA
accgccgggatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggggagctgtgcgaggacaccatcacctacaactgccccctgctccgccagaacgagcccgaggacatcgactgctggtgcaacagcaccagcacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcacgatcatggcggccatcctggcctacaccatcggcaccacctacttccagcgggtgctgatcttcatcctcctgacggccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgaccgagaacgaggtcaagctgacgatcatgaccggggacatcaagggcatcatgcaggccgggaagcggtccctccgcccgcagcccaccgagctgaagtacagctggaaggcgtggggcaaggccaaggtgctgtccaccgagctccacaaccacacgttcctgatcgacggccccgagaccgccgagtgcccgaacaccaaccgggcctggaacagcctggaggtggaggactacgggttcggcgtcttcaccacgaacatctggctcaagctgaaggagcgccaggacgtgtcctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggcggctggagatggacttcgacttctgcgagggcacgaccgtcgtggtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacgggcagatcgacaacttcagcctcggcgtgctgggcatggcgctgttcctcgaggagatgctgcgcacccgggtcgggaccaagcacgccatcctgctcgtggccgtgtccttcgtcaccctgatcacgggcaacatgagcttccgcgacctggggcgcgtgatggtgatggtcggcgccaccatgaccgacgacatcgggatgggcgtgacctacctcgccctgctggcggccttcaaggtgcggcccacgttcgccgccggcctcctgctgcgcaagctcacctccaaggagctgatgatgaccaccatcgggatcgtcctgctcagccagtccacgatccccgagaccatcctggagctgaccgacgccctcgcgctgggcatgatggtgctgaagatcgtccggaacatggagaagtaccagctcgccgtgaccatcatggccatcctgtgcgtgccgaacgccgtcatcctgcagaacgcctggaaggtgagctgcacggcgctcgccgtggtctccgtgagccccctgctgctcacctccagccagcagaagaccgactggatccccctggccctgaccatcaaggggctcaaccccacggccatcttcctgaccaccctgtcccgcaccagcaagaagcggtcctggccgctcaacgaggcgatcatggccgtgggcatggtcagcatcctggcctccagcttcctgaagaacgacatccccatgacgggccccctcgtggccgggggcctgctgaccgtgtgctacgtcctcaccgggcgcagcgccgacctggagctggagcgggcggccgacatccgctgggaggagcaggccgagatctccggcagctcccccatcctcagcatcaccatctccgaggacgggagcatgtccatcaagaacgaggaggaggagcagacgctgaccatcctgatccggaccggcctcctggtgatcagcggcctgttcccggtgtccatccccatcaccgccgccgcgtggtacctctgggaggtcaagaagcagcgcgccggggtgctgtgggacgtgcccagcccgccgcccgtcggccgggccgagctggaggacggggcctaccgcatcaagcagaagggcatcctcgggtactcccagatcggcgccggcgtgtacaaggaggggaccttccacacgatgtggcacgtgacccggggcgcggtcctgatgcacaaggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggccgtgcagaccaagcccggcctgttcaagaccaacacgggcaccatcggggccgtgagcctggacttctcccccggcaccagcggctcccccatcgtcgacaagaaggggaaggtggtgggcctgtacgggaacggcgtcgtgacccgcagcggcacgtacgtgtccgcgatcgcccagaccgagaagtccatcgaggacaaccccgagatcgaggacgacatcttccggaagaagcgcctcaccatcatggacctgcaccccggggccggcaagaccaagcggtacctgcccgccatcgtccgcgaggcgatcaagcgggggctgcgcacgctcatcctggccccgacccgcgtggtggccgccgagatggaggaggccctgcggggcctccccatccgctaccagacccccgcgatccgggccgagcacaccgggcgcgagatcgtcgacctgatgtgccacgccacgttcaccatgcggctgctcagccccatccgcgtgccgaactacaacctgatcatcatggacgaggcccacttcaccgaccccgcctccatcgcggcccggggctacatcagcacccgcgtggagatgggcgaggccgccgggatcttcatgacggccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctgcgcaagaacggcaagaaggtcatccagctcagccggaagacgttcgactccgagtacatcaagacccgcaccaacgactgggacttcgtggtgaccacggacatcagcgagatgggcgcgaacttcaaggccgagcgggtcatcgacccccgccggtgcatgaagcccgtgatcctgaccgacggggaggagcgcgtgatcctggccggccccatgccggtcacccactccagcgccgcccagcggcgcgggcgcgtgggccggaaccccaagaacgagaacgaccagtacatctacatgggggagcccctcgagaacgacgaggactgcgcgcactggaaggaggccaagatgctgctggacaacatcaacacccccgagggcatcatcccgtccatgttcgagcccgagcgcgagaaggtggacgccatcgacggcgagtaccggctccgcggggaggcccggaagacgttcgtcgacctgatgcgccggggcgacctgcccgtgtggctcgcctaccgcgtcgcggccgaggggatcaactacgccgaccggcgctggtgcttcgacggcgtgaagaacaaccagatcctggaggagaacgtggaggtcgagatctggaccaaggagggggagcggaagaagctgaagccgcgctggctcgacgcccggatctacagcgaccccctggccctgaaggagttcaaggagttcgcggccggccgcaagtccctcaccctgaacctgatcaccgagatgggccggctccccacgttcatgacccagaaggcccgcaacgccctggacaacctggcggtgctccacaccgccgaggccgggggccgggcctacaaccacgccctgagcgagctgcccgagaccctcgagacgctgctgctcctgaccctgctcgcgaccgtgaccgggggcatcttcctgttcctgatgtccggcaaggggatcggcaagatgaccctcgggatgtgctgcatcgtcacggccagcatcctgctgtggtacgcccagatccagccgcactggatcgccgcctccatcatcctcgagttcttcctgatcgtgctgctcatccccgagcccgagaagcagcgcacgccccaggacaaccagctgacctacgtggtcatcgcgatcctgaccgtggtggccgccacgatggccaacgagatgggcttcctcgagaagaccaagaaggacttcgggctgggcagcatcaccacccagcagccggagagcaacatcctggacatcgacctccggcccgcctccgcgtggacgctgtacgccgtcgccaccaccttcatcacccccatgctgcgccacagcatcgagaactccagcgtgaacgtgtccctcacggccatcgccaaccaggcgaccgtcctgatgggcctggggaagggctggcccctcagcaagatggacatcggggtgccgctgctggccatcggctgctactcccaggtgaaccccatcaccctcaccgccgccctgctgctcctggtcgcgcactacgccatcatcgggcccggcctgcaggccaaggccacgcgggaggcccagaagcgcgcggccgccggcatcatgaagaaccccaccgtggacgggatcaccgtgatcgacctcgacccgatcccctacgaccccaagttcgagaagcagctgggccaggtcatgctgctcgtgctgtgcgtgacccaggtcctgatgatgcgcacgacctgggccctctgcgaggccctgaccctggcgaccgggcccatcagcacgctctgggagggcaacccggggcggttctggaacaccaccatcgccgtgtccatggccaacatcttccgcggcagctacctggccggcgccgggctcctcttctccatcatgaagaacaccgcgaacacgcggcgcggcaccgggaacaccggcgagaccctgggcgagaagtggaagaaccggctgaacgccctcggcaagagcgagttccagatctacaagaagtccggcatccaggaggtggaccgcacgctggccaaggaggggatcaagcggggcgagaccgaccaccacgccgtcagccgcgggtccgcgaagctgcggtggttcgtggagcgcaacctcgtgacccccgagggcaaggtcgtggacctgggctgcgggcggggcgggtggagctactactgcggcgggctgaagaacgtgaaggaggtcaagggcctcaccaagggcgggcccggccacgaggagcccatcccgatgtccacgtacgggtggaacctggtgcgcctgcagagcggcgtggacgtcttcttcacgccgcccgagaagtgcgacaccctcctgtgcgacatcggggagtccagccccaacccgaccgtggaggccggccggaccctgcgcgtgctcaacctggtcgagaactggctgaacaacaacacgcagttctgcatcaaggtgctcaacccctacatgcccagcgtgatcgagaagatggaggccctgcagcggcgctacggcggggccctggtccggaacccgctgtcccgcaacagcacccacgagatgtactgggtgtccaacgccagcggcaacatcgtgtccagcgtcaacatgatctcccggatgctcatcaaccgcttcaccatgcgccacaagaaggcgacctacgagcccgacgtggacctggggagcggcacgcggaacatcgggatcgagtccgaggtgcccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcggctcctgaccaagccgtgggacgtcatccccatggtgacccagatggccatgaccgacacgacccccttcgggcagcagcgcgtcttcaaggagaaggtggacacccggacccaggagcccaaggagggcacgaagaagctgatgaagatcaccgccgagtggctctggaaggagctgggcaagaagaagaccccgcgcatgtgcacccgggaggagttcacgcgcaaggtgcggtccaacgcggccctgggggccatcttcaccgacgagaacaagtggaagtccgcccgcgaggccgtcgaggactccggcttctgggagctcgtggacaaggagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggagaacagcctgagcggggtcgagggcgaggggctccacaagctgggctacatcctgcgcgacgtgtccaagaaggagggcggggcgatgtacgccgacgacaccgccggctgggacacgcggatcaccctcgaggacctgaagaacgaggagatggtgaccaaccacatggagggggagcacaagaagctggccgaggccatcttccgcctcacctaccagaacaaggtcgtgcgggtgcagcgccccacgccccggggcaccgtcatggacatcatcagccgccgcgaccagcgggggtccggccaggtggtgacctacggcctgaacaccttcacgaacatggaggcgcagctgatccgccagatggagggggagggcgtcttcaagagcatccagcacctcaccgccaccgaggagatcgccgtgaagaactggctggtgcgggtcgggcgcgagcggctgtcccgcatggccatcagcggcgacgactgcgtggtgaagcccttcgacgaccggttcgccaacgcgctcaccgccctgaacgacatgggcaaggtccgcaaggacatccagcagtgggagccgtcccgggggtggaacgactggacccaggtgcccttctgcagccaccacttccacgagctgatcatgaaggacggccgcgtgctcgtcgtgccctgccggaaccaggacgagctgatcgggcgcgcccggatctcccagggcgccgggtggagcctgcgcgagaccgcctgcctcggcaagtcctacgcgcagatgtggagcctgatgtacttccaccggcgcgacctgcggctcgccgccaacgccatctgctccgccgtgcccagccactgggtcccgacctcccgcaccacctggagcatccacgcgacgcacgagtggatgaccaccgaggacatgctgaccgtgtggaaccgggtgtggatccaggagaacccctggatggaggacaagacgcccgtcgagtcctgggaggagatcccctacctgggcaagcgcgaggaccagtggtgcgggagcctcatcggcctgaccagccgcgccacctgggccaagaacatccagaccgccatcaaccaggtgcggtccctgatcgggaacgaggagtacacggactacatgccgagcatgaagcgcttccggcgcgaggaggaggaggcgggcgtgctctggtga

SEQ ID NO: 9766 - RNA, 9873 nt, synthetic construct
  misc_feature 1..9873: note = derived and/or modified CDS sequence (opt1) from DENV-2__KX274130__SS-prME
  source 1..9873: mol_type = other RNA
agcgccgccaccctgctgctgctggtgcccaccatcatggccttccacctcaccacccggaacggcgagccgcacatgatcgtcgcccggcacgagaaggggaagtccctgatcttcaagaccgagaacggcgtgaacatgtgcaccctgatggccatggacctcggggagctgtgcgaggagaccgtgacctacaagtgcccctacctgaagcagagcgagcccgaggacatcgactgctggtgcaacaccacctccacctgggtcacctacgggacctgcagctccagcggggagcaccgccgggagaagcgctccgtggccctcgcgccccacgtgggcatgggcctggagacccggaccgagacctggatgagctccgagggggcctggaagcacgcccagcgcatcgagaactggatcctgcggcacccgggctacaccgtcatggccgccgccatcgccatggccatcgggaccaacaacttccagcgcgccctcatcttcgtgctgctgaccgccgtggcgcccagcatgaccatgcggtgcgtcggcatcgccaaccgcgacttcgtggagggggtgtccggcggcagctgggtcgacatcgtgctcgagcacgggtcctgcgtgaccaccatggccaagaacaagcccacgctggacttcgagctgaccaagaccgaggccaagctccccgccaccctgcggaagtactgcatcgaggcgaagctgacgaacaccaccaccgagagccgctgcccgacgcagggcgagccctccctccccgaggagcaggacaagcggttcatctgccgccacagcctggtcgaccgggggtggggcaacggctgcgggctgttcggcaagggcgggatcgtgacctgcgccatgttcacgtgcaagaagtacatggaggggaagatcgtgcagcccgagaacctcgagtacaccgtcgccgtgacgccgcactccggcgaggagcacagcgtgggcaacgacaccgggaagcacggccaggacgtcaagatcacgccccagtccagcatcaccgagacggccctggaggggtacggcagcatctccatggagtgcagcccccgcaccgggctggacttcaacgagatggtgctcctgcagatggaggacaaggcctggctggtgcaccggcagtggttcctcgacctgcccctgccgtggctccccggctccgacacccagggcagcaactgggtccagaaggagaccctggtgaccttcaagaacccccacgcgaagaagcaggacgtcgtggtgctggggtcccaggagggcgccatgcacagcgccctcacgggggccaccgagatccagatgacctccggcaacctgctgttcaccgggcacctcaagtgccgcctgcggatggacaagctggagctcaagggcatgagctactccatgtgcacgggcaagttcaaggtcgtgaaggagatcgccgagacccagcacgggaccatcgtgatccgcgtccagtacgagggcgaggggagcccctgcaagatcccgttcgagatcatggacctggagaagaagcacgtgctgggccggctcatcaccgtgaaccccatcatcacggagaaggacaagcccaccaacatcgaggcggagcccccgttcggcgactcctacatcctgatcggggtcgagcccggccagctgaagatgaactggttcaagaaggggagctccatcggccagatgttcgagaccaccatgcgcggggccaagcgcatggccatcctcggcgacacggcctgggacttcggcagcctcggcggggtgttcaactccatcgggaaggcgctgcaccaggtgttcggggccgtctacaacgccgccttcagcggggtgtcctggaccatgaagatcctgatcggcgtgatcatcacctggatcggcatgaacagccggtccaccagcatgagcatcacgctcgtcatggtggggctggtgaccctgtacctcggcgtcgtggtgcaggccgactccgggtgcgtcgtgagctggaagaccaaggagctgaagtgcggctccgggatcttcgtgaccgacaacgtccacgtgtggacggagcagtacaagttccagcccgagagccccgcgaagctggccgccgccatcaagaaggcccacgaggagggcgtgtgcggcatccgctccgtcacccggctcgagaacatcatgtggaagcagatcaccccggagctgaaccacatcctgaccgagaacgacgtgaaggtgacgatcatgaccggggacatcaagggcatcctccagcaggggcgccgggcgctgcgcccccagcccaccgagctgaagtacagctggaagtcctggggcaagagcaagatcgtctccagcgagacccacaaccagacgttcctcatcgacgggccggagaccaccgagtgccccgacaccaaccgggcctggaactccctggaggtggaggactacggcttcggcctgttcagcacgaacatctggctccgcctgcgggagaagcaggacaccctgtgcgactccaagctcatgagcgccgccgtgaaggacgagcgcgccatccacgcggacatggggtactggatcgagtccaagctgaacggcagctggaagatcgagaaggcctccttcctggaggtcaagagctgcacctggccccggagccacaccctctggtccaacggggtgctggagagcgagatgatcatccccaagaacctgggcggcccggtgtcccagcacaactaccgccccgggtactacacgcagaccaccggcccctggcacctcgggaagctggagatggacttcgactactgcgagggcaccaccgtcatcgtgacggaggagtgcaacaaccgggggcccagcctgcgcaccaccaccgcctccggcaagctcatcacggagtggtgctgccggagctgcaccatgccgcccctgcgcttcaagggcgaggacgggtgctggtacggcatggagatccggcccctgaaggagaaggaggagaacctcgtgaactccctggtcaccgccgggcacggccagatcgacaacttcagcctggggatcctcggcatcgcgctgttcctggaggaggtgatgaagtcccgcatcggcatcaagcacaccatcgggatgacgatcatcaccttcctcctgctggtgaccggcaacgtcagctaccgggacctcgggcgcgtgatcctgatggtgggctccaccatggccgacgagatggggatgggcgtcacgtacctggccctcctggccaccttccgcatccggcccaccttcgccctggcgctcatgatccgcaagctgaccagcaaggagctgctcatggccacgatcggcatcgtgctgatcgcccagtgcgacgtgccggggaccatcctggagatcaccgacgcctgcgccctcggcctgatgctgctcaagatgacccgggagctggagcgctaccagctggcggtcacgctcctgtccctgacctgcatccccaacgccaccatcatgtggggcgcctggaaggtgacctgcacgatcctcaccctggtgagcatggcgcccctgttcctcaccacctcccggcagaagacggactgggtccccgtggccctgagcatctacggcctgaacccgaccgcgatctacttcaccaccctcgccaaggccaagaagatccgctcctggcccctgaacgaggccgtcatggcggtgggcatggtgagcatcctggcctccagcctcctgcggaacgacatccccatggccgggcccctggtcgccggcgggctcctgacgctgtgctacgtgctcaccggccgcagcgccgacctggagctggagaagtccgcggacatcaagtggaacgacgacgccgagatcagcgggtccagcccgatcatcaacgtggccgtctccgaggacggcagcatgtccatcaaggacgaggaggaggagaacaccctcaccatcctgatccggacgggcctgctcgccatcagcgggatgtaccccatggccatccccgcgaccgccgccgtgtggtacttctgggaggcccgcaagcagcgggccggcgtgctgtgggacgtcccctccccgccgcccaccgggaaggcggagctggaggagggcgcctaccgcatcaagcagcgggggatcttcggctacagccagatcggcgccggggtgtacaaggagggcaccttccacaccatgtggcacgtgacgcgcgggtccgtcctcatgtgcaagggcaagcggctggagccgagctgggccgacgtgaagaaggacctgatctcctacgggggcggctggcgcctcgacggggagtggaccgagggcgaggaggtgcaggtcctggccctggagcccgggaagaacccccgggcggtgcagaccaagcccggcatgttcaagaccgacacggggcgcatcggcgccgtgagcctcgacttcgccccgggcacctccgggagccccatcatcgacaagaagggcaaggtcatcgggctgtacggcaacggcgtggtgatgaagtccggggcctacgtcagctccatcgcgcagaccgagaagcgggaggacgagatccccgagatcgaggacgacatcttccgcaagcggcgcctgaccatcatggacctccaccccggcgccgggaagacgaagcgctacctgccggccatcgtgcgggaggccatcaagcgcggcctgcggaccctgatcctcgcccccacccgcgtggtcgcggccgagatggaggaggccctgcgggggctgcccatccgctaccagacccccgccatccgggccgagcacacgggccgcgagatcgtggacctcatgtgccacgcgaccttcaccatgcggctgctgagcccggtgcgcgtccccaactacaacctcatcatcatggacgaggcccacttcaccgaccccgccagcatcgccgcccggggctacatcgcgacgcgcgtggagatgggggaggccgccggcatcttcatgaccgccacgccgcccgggtccaaggaccccttcccccagagcaacgcgcccatcatggacgaggagcgggagatccccgagcgctcctggaacagcggccacgagtggatcaccgacttcgaggggaagacggtgtggttcgtcccctccatccgggccggcaacgacatcgcgacctgcctgcgcaagaacggcaagaaggtgatccagctgagccggaagaccttcgacaccgagtacatcaagacgcgcaacaacgactgggacttcgtggtcaccaccgacatctccgagatgggggccaacttcaaggccgagcgggtgatcgacccccgccgctgcatgaagcccgtgatcctcaccgacggcgaggagcgggtcatcctggcggggccgatgcccgtgacgcccagctccgccgcccagcgccggggccgcatcgggcggaaccccaagaacgagaacgaccagtacatctacatgggcgagccgctggagaacgacgaggactgcgcccactggaaggaggccaagatgctcctggacaacatcaacacccccgagggcatcatccccgcgatgttcgggccggagcgcgagaagaccgacgccatcgacggcgagtaccggctgcgcggggagagccggaagaccttcgtggagctcatgcgccggggcgacctgcccgtctggctggcctacaaggtggcctccgaggggtacagctacgccgaccgccggtggtgcttcgagggcgtgaagaacaaccagatcctcgaggagaacctggaggtcgagatctggacgaaggagggcgagcgcaagaagctgcggcccaagtggctcgacgcgcgcacctactccgacccccaggccctgaaggacttcaaggagttcgccgccgggcgcaagagcaccaccctgaacctcatcgcggagctgggccgcctgccgacgtacatgacccagaagacccgggacgccctcgacaacctggccgtgctgcacaccgccgaggagggcggccgcgcctaccagcacgcgatctccgagctccccgagacgctggagaccctgctcctgctgtgcctcctggccaccgtgagcggcggggtcttcctgttcctcatgtccggcaaggggatcggcaagatgagcatggggctgggctgcatcatcaccgcctccggcctgctctggtacgcccagatccagccccactggatcgccgcgagcatcatcctggagttcttcctgatcgtgctcctgatccccgagccggagaagcagcggacgccccaggacaaccagctgacgtacgtggtcatcgccatcctcaccctggtggccgccaccatggccaacgagatggggtacctggagaagaccaagaaggacctcggcttcgggaacccctacgtggcgagccacgaggccgccatcctggacatcgacctgcaccccgcctccgcctggacgctctacgcggtcgccaccaccctgatcaccccgatgctgcgccacagcatcgagaactccagcacgaacgtgtccctcaccgccatcgccaaccaggcgaccgtcctgatgggcctggggaagggctggcccctcagccgcatggacctgggcgtgcccctgctcgccctggggtgctactcccaggtgaaccccctgaccctcacggccagcctgctgctcctgatcggccactacgccatcatcgggccgggcctgcaggccaaggcgacccgggaggcccagaagcgcaccgccgccgggatcatgaagaaccccaccgtcgacggcatcacggtgatcgacatcgagcccatcccctacgacccgaagttcgagaagcagctcggccaggtgatgctgctggtcctctgcgtggcccaggtgctgatgatgcggaccacctgggcgatgtgcgaggccctgaccatcgccacggggcccatctccaccctctgggagggcaaccccgggaagttctggaacaccaccatcgccgtcagcatggccaacatcttccgcggctcctacctggcgggcgccgggctgctgttcagcatcatgaagaacacggtgaccggccggcgcgggaccggcgtggccggggagaccctgggcgagaagtggaagatcaagctgaacggcctcgggcggacggacttccagacctacaagcgctccggcatcatcgaggtcgaccggaccctggccaaggaggggatcaagcgcggcgagaccaaccaccacgcggtgagccgggggtccgccaagctgcgctggttcgtggagcggaacctcgtcaagcccgagggcaaggtgatcgacctgggctgcgggcgcggcgggtggagctactactgcggcgggctgaagaacgtgacggaggtcaagggcctcaccaagggcgggccgggccacgaggagcccatccccatgtccacctacgggtggaacctggtgcggctgcagagcggcgtggacgtcttcttcacgcccccggagaagtgcgacacgctcctgtgcgacatcggggagtccagccccaaccccaccatcgaggccggccgcaccctgcgggtgctcaacatggtggagaactggctgggcaacaaccagttctgcatcaaggtcctgaacccgtacatgcccagcgtgatcgagaagatggagaacctccagcgcaagttcgggggcaccctggtgcggaaccccctgtcccgcaacagcacccacgagatgtactgggtctccaacgccagcgggaacatcgtgtccagcgtgaacatgatctcccgcatgctgatcaaccggttcacgatgaagcacaagaagcccacctacgagcaggacgtcgacctcggcagcggcacccgcaacgtggggatcgagaccgagaagccgaacctggagatcatcggcaagcggatcgagaagatcaaggacgagcacaagcagacgtggcactacgacctggaccacccctacaagacctgggcctaccacgggtcctacgagaccaagcagaccggcagcgcgtccagcatgatcaacggggtggtcaagctcctgacgaagccctgggacgtgatccccatggtgacccagatggccatgaccgacaccacgccgttcggccagcagcgcgtcttcaaggagaaggtggacacccggacccccgagcccaaggagggcaccaagaagctgatgaagctcacggccaagtggctgtgggccgagctggggcgccacaaggtgccccggatgtgcacccgcgacgagttcaccaacaaggtccggtccaacgccgcgatgggcgccgtgttcaccgaggagaaccgctggagctccgccaaggaggccgtggaggacgaggccttctgggacctcgtcgaccgggagcgcaagctgcacctccaggggaagtgcgagacgtgcgtgtacaacatgatgggcaagcgggagaagaagctcggggagttcggccgcgcgaagggcagccgggccatctggtacatgtggctgggggcccgcttcctggagttcgaggccctcggcttcctgaacgaggaccactggttctcccgggagaacagcctgtccggggtggagggcgaggggctccacaagctgggctacatcctgcgcgagatcggcgcgaaggacgggggcatgatgtacgccgacgacaccgccgggtgggacacccgggtcaccgaggaggacctcaagaacgaggagatgatcagcgagcagatgaagggcgagcaccgcacgctggccgaggccatcttcaagctgacctaccagaacaaggtggtgcgggtccagcgcccgacccccaagggcaccgtgatggacatcatcagccgccgggaccagcgcgggtccggccaggtggggacgtacggcctcaacaccttcaccaacatggaggcgcagctgatccggcagatggagggggagggcctgttccgcgacatcagcaagctcaccatccaggaggagacggccatcctgacctggctgaaggagaagggccgggaccgcctctcccggatggccatcagcggggacgactgcgtcgtgaagcccgtcgacgaccgcttcgcccacgccctgaccgcgctgaacgacatgggcaaggtgcggaaggacatccagcagtgggaggcctccaaggggtggaacgactggacccaggtgcccttctgcagccaccacttccacgagatcatcatgaaggacggccgcaagctcgtcgtgccgtgccggaaccaggacgagctgatcgggcgcgcccggatctcccagggcgccggctgggccctgaaggagacggcgtgcctcgggaaggcctacgcccagatgtggagcctgatgtacttccaccgccgggacctgcgcctcgccgccaacgcgatctgctccgccgtgcccagccactgggtccccacctcccggaccacctggagcatccacgcccaccaccagtggatgaccacggaggacatgctggacgtgtggaaccgcgtgtggatcctggagaacccctggatggacgacaagacctgcgtcaagtcctgggaggaggtgccgtacctcggcaagcgggaggaccagtggtgcgggagcctgatcggcctgacctcccgcgccacctgggcgaagaacatcaaggtggccatcgagcaggtccgcagcctcatcgggaaggaggagtacacggactacatgccctccatgaagcggttcaagcaggagcagagcaccgagggcgccctgtggtga

SEQ ID NO: 9767 - RNA, 9876 nt, synthetic construct
  misc_feature 1..9876: note = derived and/or modified CDS sequence (opt1) from DENV-2__GU289914__SS-prME
  source 1..9876: mol_type = other RNA
agcgcggggatgatcatcatgctgatccccaccgtgatggccttccacctcaccacccgcaacggggagccccacatgatcgtgtcccggcaggagaagggcaagagcctgctgttcaagaccgaggacggggtgaacatgtgcaccctcatggcgatggacctgggcgagctgtgcgaggacaccatcacctacaactgccccctcctgcgccagaacgagcccgaggacatcgactgctggtgcaactccaccagcacctgggtgacctacgggacctgcaccaccaccggcgagcaccggcgcgagaagcggtccgtcgccctggtgccccacgtgggcatggggctcgagacgcgcaccgagacctggatgagctccgagggcgcctggaagcacgcccagcggatcgagacctggatcctgcgccacccggggttcacgatcatggccgcgatcctggcctacaccatcggcaccacccacttccagcgggccctcatcttcatcctgctgacggccgtcgcgcccagcatgaccatgcgctgcatcgggatctccaaccgggacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccgcaagtactgcatcgaggccaagctgaccaacacgaccaccgagtcccggtgccccacccagggggagcccagcctgaacgaggagcaggacaagcgcttcgtctgcaagcactccatggtggaccggggctggggcaacgggtgcggcctcttcgggaagggcgggatcgtgacgtgcgcgatgttcacgtgcaagaagaacatggagggcaaggtcgtgcagcccgagaacctggagtacaccatcgtggtcacgccccacagcggcgaggagcacgccgtggggaacgacacgggcaagcacgggaaggagatcaaggtgaccccgcagtccagcatcaccgaggccgagctgaccggctacgggaccgtcacgatggagtgcagcccccgcaccggcctcgacttcaacgagatggtgctgctgcagatggagaacaaggcctggctcgtgcaccggcagtggttcctggacctgcccctcccctggctgccgggcgccgacacccaggggagcaactggatccagaaggagaccctggtcacgttcaagaacccccacgcgaagaagcaggacgtggtcgtgctcggcagccaggagggggccatgcacaccgccctgaccggcgccaccgagatccagatgtccagcgggaacctcctgttcacgggccacctgaagtgccgcctgcggatggacaagctccagctgaagggcatgtcctacagcatgtgcaccgggaagttcaaggtggtcaaggagatcgccgagacccagcacggcaccatcgtgatccgcgtgcagtacgagggggacggctccccctgcaagatccccttcgagatcatggacctggagaagcggcacgtcctcggccgcctgatcacggtgaacccgatcgtgaccgagaaggacagccccgtcaacatcgaggcggagccgcccttcggggactcctacatcatcatcggcgtggacccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtcttcggggcgatctacggcgccgccttcagcggcgtgtcctggaccatgaagatcctgatcggggtgatcatcacctggatcggcatgaacagccgctccacgagcctgtccgtcagcctggtgctcgtggggatcgtcaccctgtacctgggcgtgatggtgcaggccgactccgggtgcgtcgtgagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccggagcgtcacccgcctggagaacctcatgtggaagcagatcacccccgagctgaaccacatcctggccgagaacgaggtgaagctcaccatcatgacgggggacatcaagggcatcatgcaggccgggaagcggtccctgcgcccgcagcccaccgagctgaagtacagctggaagacctggggcaaggcgaagatgctctccaccgagagccacaaccagacgttcctgatcgacggccccgagaccgccgagtgcccgaacaccaaccgggcctggaactccctggaggtggaggactacgggttcggcgtcttcaccacgaacatctggctcaagctgaaggagaagcaggacgccttctgcgacagcaagctgatgtccgccgcgatcaaggacaaccgcgccgtgcacgccgacatggggtactggatcgagagcgccctcaacgacacctggaagatcgagaaggcctccttcatcgaggtgaagaactgccactggcccaagagccacaccctgtggtccaacggcgtcctggagagcgagatgatcatccccaagaacctcgcgggccccgtgtcccagcacaactaccggccggggtaccacacccagatcgccggcccctggcacctggggaagctggagatggacttcgacttctgcgacggcaccacggtggtcgtgaccgaggactgcgggaaccgcggccccagcctccggaccaccacggccagcggcaagctgatcaccgagtggtgctgccgctcctgcaccctgcccccgctccggtaccgcggggaggacggctgctggtacgggatggagatccggcccctgaaggagaaggaggagaacctggtgaacagcctcgtcaccgccggccacggccaggtggacaacttctccctgggcgtgctgggcatggccctgttcctggaggagatgctgcgcacgcgggtcgggaccaagcacgccatcctcctggtggccgtgagcttcgtcaccctgatcaccggcaacatgtccttccgcgacctcgggcgggtggtggtcatggtgggcgccacgatgaccgacgacatcgggatgggcgtgacctacctggccctgctcgcggccttcaaggtccgccccaccttcgccgccggcctgctgctccgcaagctgacgagcaaggagctgatgatgaccaccatcgggatcgtgctcctgtcccagagcaccatccccgagacgatcctggagctcaccgacgccctggcgctgggcatgatggtgctcaagatggtccggaacatggagaagtaccagctggccgtgaccatcatggccatcctgtgcgtcccgaacgccgtgatcctccagaacgcctggaaggtgtcctgcaccatcctggcggtcgtgagcgtgagccccctgctcctgacgagctcccagcagaagaccgactggatccccctggccctcaccatcaaggggctgaaccccaccgccatcttcctgacgaccctcagccgcacctccaagaagcggagctggccgctgaacgaggccatcatggcggtcggcatggtgtccatcctggccagctccctcctgaagaacgacatccccatgaccggccccctggtggccgggggcctcctgacggtctgctacgtgctgaccgggcgcagcgccgacctcgagctggagcgggccgcggacgtgaagtgggaggaccaggccgagatcagcggctccagccccatcctgtccatcaccatcagcgaggacgggtccatgagcatcaagaacgaggaggaggagcagaccctcacgatcctgatccgcaccggcctgctcgtcatctccggcctgttcccggtgagcatccccatcaccgccgccgcctggtacctgtgggaggtgaagaagcagcgggcgggggtcctctgggacgtgcccagcccgccgcccatgggcaaggccgagctggaggacggggcctaccgcatcaagcagaagggcatcctggggtacagccagatcggcgccggcgtgtacaaggaggggaccttccacaccatgtggcacgtcacgcggggcgccgtgctcatgcacaaggggaagcgcatcgagccctcctgggcggacgtgaagaaggacctgatcagctacggcgggggctggaagctggagggcgagtggaaggagggggaggaggtccaggtgctcgccctggagcccggcaagaacccccgggccgtgcagaccaagcccgggctgttccgcaccaacgccggcaccatcggggccgtctccctcgacttcagccccggcacgtccggcagccccatcatcgacaagaaggggaaggtggtgggcctgtacgggaacggcgtcgtgacccggtccggcgcgtacgtgagcgccatcgcccagaccgagaagtccatcgaggacaaccccgagatcgaggacgacatcttccgcaagcggcgcctgaccatcatggacctgcaccccggggccggcaagacgaagcggtacctccccgcgatcgtccgcgaggccatcaagcgggggctgcgcaccctgatcctcgccccgacccgggtggtggccgccgagatggaggaggcgctgcgcggcctgcccatccgctaccagacccccgccatccgggccgagcacacggggcgcgagatcgtcgacctcatgtgccacgccaccttcaccatgcggctgctgagccccgtgcgcgtgccgaactacaacctcatcatcatggacgaggcccacttcaccgaccccgcgagcatcgccgcccggggctacatctccacgcgcgtcgagatgggcgaggccgccgggatcttcatgaccgcgacgccgcccggcagccgggacccgttcccccagtccaacgcccccatcatcgacgaggagcgcgagatccccgagcggagctggaactccgggcacgagtgggtgaccgacttcaagggcaagacggtgtggttcgtcccgagcatcaaggccgggaacgacatcgccgcgtgcctgcgcaagaacggcaagaaggtgatccagctgtcccggaagaccttcgacagcgagtacgtgaagacccgcaccaacgactgggacttcgtcgtgacgaccgacatctccgagatgggcgccaacttcaaggccgagcgggtgatcgacccccgccggtgcatgaagcccgtcatcctcaccgacggggaggagcgcgtgatcctggccggccccatgccggtgacccacagctccgccgcgcagcggcgcgggcggatcggccgcaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgcgagaaggtcgacgccatcgacggcgagtaccggctgcgcggggaggcccggaagaccttcgtggacctcatgcgccggggcgacctgcccgtgtggctggcgtacaaggtcgccgccgaggggatcaactacgccgaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgcgctgaaggagttcaaggagttcgccgccggccggaagtccctgaccctcaacctgatcacggagatgggccgcctgcccaccttcatgacccagaaggcccgggacgcgctcgacaacctggccgtgctgcacaccgccgaggccgggggccgcgcctacaaccacgcgctctccgagctgcccgagacgctggagaccctcctgctgctcaccctgctggccaccgtgaccggcgggatcttcctcttcctgatgagcgggcgggggatcggcaagatgaccctggggatgtgctgcatcatcaccgcctccatcctcctgtggtacgcccagatccagccgcactggatcgccgcgagcatcatcctggagttcttcctcatcgtcctgctgatccccgagcccgagaagcagcgcacgccccaggacaaccagctcacctacgtggtgatcgccatcctgacggtcgtggccgccaccatggccaacgagatgggcttcctggagaagaccaagaaggacctcgggctgggctccatcgcgacccagcagccggagagcaacatcctggacatcgacctccggcccgccagcgcctggacgctgtacgccgtggccaccaccttcgtcacccccatgctgcgccactccatcgagaacagctccgtgaacgtgagcctcacggcgatcgccaaccaggccaccgtcctgatgggcctggggaagggctggcccctctccaagatggacatcggggtgccgctgctggccatcggctgctacagccaggtgaaccccatcaccctcaccgcggccctgctgctcctggtcgcccactacgccatcatcgggcccggcctgcaggccaaggcgacgcgggaggcccagaagcgcgccgccgccggcatcatgaagaaccccaccgtggacgggatcaccgtgatcgacctcgacccgatcccctacgaccccaagttcgagaagcagctgggccaggtcatgctgctcgtgctgtgcgtgacccaggtcctgatgatgcggacgacctgggcgctctgcgaggccctgaccctggccaccgggcccatctccacgctctgggagggcaacccggggcgcttctggaacaccaccatcgccgtgagcatggccaacatcttccgcggctcctacctggcgggcgccgggctcctcttcagcatcatgaagaacaccacgaacacccggcgcggcaccgggaacatcggcgagaccctgggcgagaagtggaagtcccggctgaacgccctcgggaagtccgagttccagatctacaagaagtccggcatccaggaggtggaccgcacgctggccaaggaggggatcaagcggggcgagaccgaccaccacgcggtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacgtacgggtggaacctcgtgcggctgcagagcggcgtggacgtcttcttcatcccgcccgagaagtgcgacaccctgctctgcgacatcggggagtccagccccaacccgaccgtggaggccggccgcaccctgcgggtgctgaacctcgtcgagaactggctgaacaacaacacgcagttctgcatcaaggtgctgaacccctacatgcccagcgtgatcgagaagatggagaccctgcagcgcaagtacggcggggccctcgtccggaacccgctgtcccgcaacagcacccacgagatgtactgggtgtccaacgccagcggcaacatcgtgtccagcgtcaacatgatctcccggatgctgatcaaccgcttcaccatgcggcacaagaaggcgacctacgagcccgacgtggacctcgggagcggcacgcgcaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtgaacggcgtcgtgcggctgctcaccaagccgtgggacgtggtccccatggtgacccagatggccatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagaccccgcgcatgtgcacccgggaggagttcacgcgcaaggtgcggtccaacgcggccctgggggccatcttcaccgacgagaacaagtggaagtccgcccgcgaggccgtcgaggactcccggttctgggagctggtggacaaggagcgcaacctccacctggagggcaagtgcgagacctgcgtgtacaacatgatggggaagcgggagaagaagctgggcgagttcgggaaggcgaagggcagccgcgccatctggtacatgtggctcggcgcccggttcctggagttcgaggccctggggttcctcaacgaggaccactggttctcccgcgagaacagcctgagcggcgtcgagggggagggcctgcacaagctcgggtacatcctgcgggacgtgtccaagaaggagggcggcgcgatgtacgccgacgacaccgccgggtgggacacgcgcatcaccctggaggacctcaagaacgaggagatggtgaccaaccacatggagggcgagcacaagaagctggccgaggccatcttcaagctgacctaccagaacaaggtcgtgcgggtgcagcgccccacgccccgggggaccgtcatggacatcatcagccgccgggaccagcgcggctccggccaggtgggcacctacggcctcaacaccttcacgaacatggaggcgcagctgatccgccagatggagggggagggcgtgttcaagaacatccagcacctgaccgtcaccgaggagatcgccgtgcagaactggctcgcccgggtggggcgcgagcggctgagccgcatggccatctccggcgacgactgcgtcgtgaagcccctggacgaccggttcgccagcgcgctcaccgccctgaacgacatgggcaagatccgcaaggacatccagcagtgggagccgtcccgggggtggaacgactggacgcaggtccccttctgcagccaccacttccacgagctgatcatgaaggacggccgcgtcctcgtggtgccctgccggaaccaggacgagctgatcgggcgcgcccggatctcccagggcgccgggtggagcctgcgcgagaccgcctgcctcggcaagtcctacgcgcagatgtggagcctgatgtacttccaccggcgcgacctgcggctcgccgccaacgccatctgctccgccgtccccagccactgggtgccgacctcccgcaccacgtggagcatccacgcgaagcacgagtggatgaccaccgaggacatgctgaccgtgtggaaccgggtctggatccaggagaacccctggatggaggacaagacccccgtggagtcctgggaggagatcccctacctgggcaagcgcgaggaccagtggtgcgggagcctcatcggcctgacgagccgggccacctgggccaagaacatccaggccgcgatcaaccaggtgcgctccctgatcgggaacgaggagtacaccgactacatgccgagcatgaagcgcttccggcgcgaggaggaggaggccggcgtcctctggtga

SEQ ID NO: 9768 - RNA, 9876 nt, synthetic construct
  misc_feature 1..9876: note = derived and/or modified CDS sequence (opt1) from DENV-2__AY858036__SS-prME
  source 1..9876: mol_type = other RNA
accgccggcatcatcatcatgatgatccccaccgtgatggccttccacctgaccacccggaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgctggtgcaacagcacctccacctgggtgacctacgggacctgcaccgccaccggcgagcaccggcgcgagaagcggagcgtcgccctggtgccccacgtgggcatggggctggagacccgcaccgagacctggatgtccagcgagggcgcctggaagcacgcccagcggatcgagacctgggtcctccgccaccccgggttcaccatcatggcggccatcctggcctacaccatcggcaccacctacttccagcgggtgctgatcttcatcctcctgaccgccgtggcgccctccatgaccatgcgctgcatcgggatcagcaaccgggacttcgtcgagggcgtgtccggcgggagctgggtggacatcgtcctggagcacggctcctgcgtgaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtcgaccggggctggggcaacgggtgcggcctgttcgggaagggcgggatcgtgacgtgcgccatgttcacgtgcaagaagaacatggagggcaagatcgtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggagaacaaggcctggctggtgcaccggcagtggttcctcgacctgcccctgccctggctcccgggcgcggacacccaggggtccaactggatccagaaggagaccctggtcacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcgtgaccgacaacgtgcacacctggacggagcagtacaagttccagcccgagtcccccagcaagctcgcctccgccatccagaaggcccacgaggaggggatctgcggcatccggagcgtcacccgcctggagaacctgatgtggaagcagatcacccccgagctcaaccacatcctgtccgagaacgaggtgaagctgaccatcatgacgggggacatcaagggcatcatgcaggccgggaagcggagcctccgcccgcagcccaccgagctgaagtactcctggaagacctggggcaaggcgaagatgctgagcaccgagctccacaaccacacgttcctgatcgacggccccgagaccgccgagtgcccgaacaccaaccgggcctggaactccctggaggtggaggactacgggttcggcgtcttcaccacgaacatctggctcaagctgaaggagcgccaggacgtgttctgcgacagcaagctgatgtccgccgccatcaaggacaaccgggcggtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccggccccgtgagccagcacaactaccgcccggggtaccacacccagaccgcgggcccctggcacctcgggcggctggagatggacttcgacttctgcgagggcacgaccgtcgtggtgaccgaggactgcgggaaccgcggccccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacgggcagatcgacaacttcagcctcggcgtgctgggcatggccctgttcctcgaggagatgctgcgcacccgggtcgggaccaagcacgcgatcctgctcgtggccgtgtccttcgtcaccctgatcacgggcaacatgagcttccgcgacctggggcgcgtgatggtgatggtcggcgccaccatgaccgacgacatcgggatgggcgtgacctacctcgccctgctggccgcgttcaaggtgcggcccacgttcgccgccggcctcctgctgcgcaagctcacctccaaggagctgatgatgaccaccatcgggatcgtcctgctcagccagtccacgatccccgagaccatcctggagctgaccgacgccctcgccctgggcatgatggtgctgaagatcgtccggaacatggagaagtaccagctcgcggtgaccatcatggccatcctgtgcgtgccgaacgccgtcatcctgcagaacgcctggaaggtgagctgcacgaccctcgccgtggtctccgtgagccccctgctgctcacctccagccagcagaaggcggactggatccccctggccctgaccatcaaggggctcaaccccacggccatcttcctgaccaccctggcccgcacctccaagaagcggagctggccgctcaacgaggcgatcatggccgtgggcatggtctccatcctggccagctccctgctcaagaacgacatccccatgacgggccccctggtggccgggggcctgctcaccgtgtgctacgtcctgaccgggcgcagcgccgacctggagctcgagcgggcggccgacgtgcgctgggaggagcaggccgagatcagcggctccagccccatcctgtccatcaccatcagcgaggacgggtccatgagcatcaagaacgaggaggaggagcagacgctgaccatcctcatccggaccggcctgctggtgatctccggcctcttcccggtcagcatccccatcaccgccgccgcgtggtacctgtgggaggtgaagaagcagcgcgccggggtgctgtgggacgtccccagcccgccgcccgtgggcaaggccgagctcgaggacggggcctaccggatcaagcagaagggcatcctggggtacagccagatcggcgccggcgtgtacaaggaggggaccttccacacgatgtggcacgtcacccgcggcgcggtgctgatgcacaaggggaagcggatcgagccctcctgggccgacgtgaagaaggacctcatcagctacggcgggggctggaagctggagggcgagtggaaggagggggaggaggtccaggtgctggccctcgagcccggcaagaacccccgcgccgtgcagaccaagcccgggctgttcaagaccaacacgggcaccatcggggccgtctccctggacttcagccccggcacctccggcagccccatcgtggacaagaaggggaaggtggtcggcctctacgggaacggcgtggtgacccggtccggcacgtacgtcagcgcgatcgcccagaccgagaagtccatcgaggacaaccccgagatcgaggacgacatcttccgcaagaagcggctgaccatcatggacctgcaccccggggccggcaagaccaagcgctacctgcccgccatcgtgcgggaggcgatcaagcgcgggctccggacgctgatcctggccccgacccgcgtggtcgccgccgagatggaggaggccctccgcggcctgcccatccggtaccagacccccgcgatccgcgccgagcacaccgggcgggagatcgtggacctgatgtgccacgccacgttcaccatgcgcctcctgagccccatccgggtgccgaactacaacctgatcatcatggacgaggcccacttcaccgaccccgccagcatcgcggcccgcggctacatctccacccgggtcgagatgggcgaggccgccgggatcttcatgacggccacgccgcccggcagccgcgacccgttcccccagtccaacgcgcccatcatggacgaggagcgggagatccccgagcgcagctggaactccgggcacgagtgggtgaccgacttcaagggcaagaccgtgtggttcgtcccgagcatcaaggccgggaacgacatcgccgcctgcctccggaagaacggcaagaaggtgatccagctgtcccgcaagacgttcgacagcgagtacatcaagacccggaccaacgactgggacttcgtggtcaccacggacatctccgagatgggcgcgaacttcaaggccgagcgcgtgatcgacccccggcgctgcatgaagcccgtgatcctgaccgacggggaggagcgggtcatcctcgccggccccatgccggtgacccacagctccgccgcccagcgccgggggcgcgtgggccgcaaccccaagaacgagaacgaccagtacatctacatgggggagcccctggagaacgacgaggactgcgcgcactggaaggaggccaagatgctgctcgacaacatcaacacccccgagggcatcatcccgagcatgttcgagcccgagcgggagaaggtcgacgccatcgacggcgagtaccgcctgcgcggggaggcccgcaagacgttcgtggacctgatgcggcgcggcgacctccccgtctggctggcctaccgggtggcggccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctactccgaccccctggccctcaaggagttcaaggagttcgcggccggccggaagtccctgaccctgaacctcatcaccgagatgggccgcctgcccacgttcatgacccagaaggcccggaacgccctggacaacctcgcggtgctgcacaccgccgagaccgggggccgcgcctacaaccacgccctgtccgagctccccgagacgctggagaccctgctcctgctgaccctcctggccaccgtcaccgggggcatcttcctgttcctcatgagcggcaaggggatcggcaagatgacgctggggatgtgctgcatcatcaccgcgtccatcctgctctggtacgcccagatccagccgcactggatcgccgccagcatcatcctggagttcttcctgatcgtgctcctgatccccgagcccgagaagcagcggacgccccaggacaaccagctgacctacgtggtcatcgccatcctcacggtggtggcggccaccatggccaacgagatgggcttcctggagaagaccaagaaggacttcgggctgggctccatcaccacgcagcagccggagagcaacatcctcgacatcgacctgcgccccgccagcgcctggaccctgtacgcggtcgccaccaccttcatcacgcccatgctccggcactccatcgagaacagctccgtgaacgtgagcctgaccgccatcgccaaccaggccaccgtcctgatgggcctcgggaagggctggcccctgtccaagatggacatcggggtgccgctgctcgcgatcggctgctacagccaggtgaaccccatcaccctgacggccgccctgctcctgctggtcgcccactacgcgatcatcgggcccggcctccaggccaaggccacccgcgaggcccagaagcgggccgcggccggcatcatgaagaaccccaccgtggacgggatcaccgtgatcgacctggacccgatcccctacgaccccaagttcgagaagcagctgggccaggtcatgctcctggtgctgtgcgtgacgcaggtcctcatgatgcgcaccacctgggccctgtgcgaggccctgaccctcgccacggggcccatctccaccctgtgggagggcaacccggggcgcttctggaacaccaccatcgcggtgagcatggccaacatcttccggggctcctacctggccggcgccgggctcctgttcagcatcatgaagaacacggccaacacccgccggggcaccgggaacaccggcgagacgctgggcgagaagtggaagaaccgcctcaacgcgctggggaagtccgagttccagatctacaagaagtccggcatccaggaggtggaccggaccctggccaaggaggggatcaagcgcggcgagaccgaccaccacgccgtctcccgggggagcgccaagctccgctggttcgtggagcggaacctggtgacccccgagggcaaggtcgtggacctgggctgcgggcgcggcgggtggtcctactactgcggcgggctcaagaacgtgaaggaggtcaagggcctgacgaagggcgggcccggccacgaggagcccatcccgatgagcacctacgggtggaacctggtgcggctccagtccggcgtggacgtcttcttcacgccgcccgagaagtgcgacaccctgctgtgcgacatcggggagagctcccccaacccgaccgtggaggcgggccgcacgctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctcagccgcaactccacccacgagatgtactgggtgagcaacgcctccggcaacatcgtgagctccgtcaacatgatcagccggatgctgatcaaccgcttcaccatgcggcacaagaaggccacgtacgagcccgacgtggacctggggtccggcacccgcaacatcgggatcgagagcgagacccccaacctcgacatcatcggcaagcgcatcgagaagatcaagcaggagcacgagacctcctggcactacgaccaggaccacccctacaagacgtgggcgtaccacggcagctacgagaccaagcagaccgggtccgccagctccatggtgaacggcgtcgtgcggctgctgaccaagccgtgggacgtgatccccatggtcacgcagatggccatgaccgacaccacccccttcgggcagcagcgcgtgttcaaggagaaggtcgacacgcggacccaggagcccaaggagggcaccaagaagctcatgaagatcaccgccgagtggctgtggaaggagctgggcaagaagaagacgccgcgcatgtgcacccgggaggagttcacccgcaaggtgcggagcaacgccgcgctcggggccatcttcaccgacgagaacaagtggaagtccgcccgcgaggccgtggaggacagcgagttctgggagctggtcgacaaggagcggaacctgcacctcgagggcaagtgcgagacgtgcgtgtacaacatgatggggaagcgcgagaagaagctgggcgagttcgggaaggccaagggctcccgggcgatctggtacatgtggctgggcgcccgcttcctcgagttcgaggccctggggttcctgaacgaggaccactggttcagccgggagaactccctcagcggcgtggagggggagggcctgcacaagctggggtacatcctccgcgacgtcagcaagaaggagggcggcgccatgtacgcggacgacaccgccgggtgggacacccggatcaccctggaggacctgaagaacgaggagatggtgacgaaccacatggagggcgagcacaagaagctcgccgaggccatcttccgcctgacctaccagaacaaggtggtccgggtgcagcgccccacgccccgggggaccgtgatggacatcatctcccgccgggaccagcgcggcagcgggcaggtcgtgacgtacggcctgaacaccttcaccaacatggaggcccagctcatccgccagatggagggcgagggggtgttcaagtccatccagcacctgaccgtcacggaggagatcgcggtgaagaactggctggtgcgggtcggccgcgagcggctcagccgcatggccatctccggggacgactgcgtggtgaagcccctggacgaccggttcgccagcgccctgaccgccctcaacgacatgggcaaggtccgcaaggacatccagcagtgggagccgtcccggggctggaacgactggacccaggtgcccttctgcagccaccacttccacgagctgatcatgaaggacgggcgcgtgctggtcgtgccctgccggaaccaggacgagctcatcggccgcgcgcggatctcccagggggccggctggagcctgcgcgagaccgcctgcctggggaagtcctacgcccagatgtggagcctcatgtacttccaccggcgcgacctgcggctggccgcgaacgccatctgctccgccgtgcccagccactgggtcccgacctcccgcacgacctggagcatccacgccacccacgagtggatgaccacggaggacatgctcaccgtgtggaaccgggtgtggatccaggagaacccctggatggaggacaagacccccgtcgagtcctgggaggagatcccctacctgggcaagcgcgaggaccagtggtgcggcagcctgatcgggctcaccagccgggccacgtgggcgaagaacatccagaccgccatcaaccaggtgcgctccctgatcggcaacgaggagtacaccgactacatgccgagcatgaagcgcttccggcgcgaggaggaggaggccggggtgctgtggtga

SEQ ID NO: 9769 - RNA, 9876 nt, synthetic construct
  misc_feature 1..9876: note = derived and/or modified CDS sequence (opt1) from DENV-2__HQ332184__SS-prME
  source 1..9876: mol_type = other RNA
accgcgggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctcttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccggctgggacttcgggagcctgggcggggtgttcacctccatcggcaaggccctccaccaggtgttcggcgccatctacggggcggccttcagcggcgtctcctggaccatgaagatcctgatcggggtggtgatcacgtggatcggcatgaacagccgctccaccagcctgtccgtcagcctggtgctcgtgggggtcgtgaccctgtacctgggcgccatggtgcaggccgactccggctgcgtcgtgagctggaagaacaaggagctcaagtgcgggtccggcatcttcatcaccgacaacgtgcacacgtggaccgagcagtacaagttccagcccgagagccccagcaagctggcgtccgccatccagaaggcccacgaggaggggatctgcggcatccggagcgtcacccgcctggagaacctcatgtggaagcagatcacccccgagctgaaccacatcctgtccgagaacgaggtgaagctcacgatcatgaccggggacaccaagggcatcatgcaggccggcaagcggagcctgcgcccgcagcccaccgagctgaagtactcctggaagacgtgggggaaggccaagatgctcagcaccgagtcccacaaccagaccttcctgatcgacggccccgagaccgcggagtgcccgaacacgaaccgggcctggaacagcctggaggtggaggactacgggttcggcgtcttcaccaccaacatctggctcaagctgcgcgagaagcaggacgtgttctgcgactccaagctgatgagcgccgccatcaaggacaaccgggccgtgcacgcggacatgggctactggatcgagtccgccctcaacgacacctggaagatggagaaggccagcttcatcgaggtcaagtcctgccactggcccaagagccacaccctgtggtccaacggggtgctggagagcgagatgatcatccccaagaacttcgccggccccgtgtcccagcacaactaccgcccggggtaccacacgcagaccgccggcccctggcacctcgggaagctggagatggacttcgacttctgcgagggcaccaccgtcgtggtgacggaggactgcggcaaccgggggcccagcctgcgcaccaccaccgcgagcggcaagctcatcacggagtggtgctgccggtcctgcaccctgcccccgctgcgctaccgcggggaggacggctgctggtacgggatggagatccgccccctcaaggagaaggaggagaacctggtcaacagcctggtgaccgccggccacggccagatcgacaacttctccctcggggtgctgggcatggccctgttcctcgaggagatgctgcggacccgcgtcgggacgaagcacgccaccctgctcgtggcggccagcttcgtgaccctgatcaccggcaacatgtccttccgggacctggggcgcgtcatggtgatggtgggcgccacgatgaccgacgacatcggcatgggggtcacctacctcgccctgctggccgcgttcaaggtgcgccccaccttcgccgccggcctcctgctgcggaagctcacgagcaaggagctgatgatggccaccatcgggatcaccctgctctcccagagcaccatccccgagacgatcctggagctgaccgacgccctcgcgctgggcatgatggtgctgaagatcgtccgcaacatggagaagtaccagctcgccgtgaccatcatggccatctcctgcgtgccgaacgccgtcatcctgcggaacgcctggaaggtgagctgcaccatcctggcggccgtgtccgtcagccccctcctgctgacgtccagccagcagaaggccgactggatccccctcgccctgaccatcaagggcctgaaccccaccgcgatcttcctcaccacgctgtcccgcaccagcaagaagcggtcctggccgctgaacgaggccatcatggccgtggggatggtcagcatcctcgcctccagcctgctgaagaacgacatccccatgaccggccccctcgtggccgggggcctgctgaccgtgtgctacgtcctcacggggcgcagcgcggacctggagctggagcgggccgccgacgtgaagtgggaggaccaggccgagatctccggcagctcccccatcctcagcatcaccatctccgaggacggcagcatgtccatcaagaacgaggaggaggagcagaccctgaccatcctgatccgcaccgggctcctggtgatcagcggcgtcttcccggtgtccatccccatcacggccgcggcctggtacctgtgggaggtgaagaagcagcgggccggggtcctctgggacgtgcccagcccgccgcccgtgggcaaggccgagctggaggacggggcctaccgcatcaagcagcggggcatcctgggctactcccagatcggggcgggcgtctacaaggaggggaccttccacaccatgtggcacgtgacccgcggcgccgtgctcatgcaccgggggaagcgcatcgagcccagctgggccgacgtcaagaaggacctgatctcctacggcggcgggtggaagctggagggcgagtggaaggagggggaggaggtccaggtgctcgccctggagcccggcaagaacccccgggccgtccagacgaagcccgggatcttcaagaccaacaccggcaccatcggcgcggtgagcctggacttctcccccgggacgagcggctcccccatcgtggaccgcaaggggaaggtcgtgggcctctacggcaacggggtggtcacccggagcggcgcctacgtgtccgccatcgcccagaccgagaagtccatcgaggacaaccccgagatcgaggacgacatcttccgcaagaagcggctgaccatcatggacctgcaccccggggcgggcaagacgaagcgctacctccccgccatcgtgcgggaggccatcaagcgcgggctgcgcaccctgatcctggccccgacccgggtcgtggccgcggagatggaggaggccctccgcggcctgcccatccggtaccagacccccgccatcaaggccgagcacacgggccgcgagatcgtggacctgatgtgccacgccaccttcaccatgcggctcctgagccccgtccgcgtgccgaactacaacctgatcatcatggacgaggcgcacttcaccgaccccgcctccatcgccgcccgggggtacatcagcacgcgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtcaccgacttcaagggcaagacggtgtggttcgtgccgtccatcaaggccggcaacgacatcgcggcctgcctccgcaagaacgggaagaaggtcatccagctgagccggaagaccttcgactccgagtacgtgaagacccgcgccaacgactgggacttcgtggtcaccacggacatcagcgagatgggcgccaacttcaaggccgagcgggtgatcgacccccgccggtgcatgaagcccgtgatcctgaccgacggggaggagcgcgtcatcctcgcgggccccatgccggtgacccactccagcgccgcccagcggcgcgggcgcatcggccggaaccccaagaacgagaacgaccagtacatctacatgggcgagcccctggagaacgacgaggactgcgcccactggaaggaggccaagatgctgctcgacaacatcaacacccccgaggggatcatcccgtccatgttcgagcccgagcgcgagaaggtggacgcgatcgacggcgagtaccggctgcgcggggaggcccggaagacgttcgtcgacctgatgcgccggggcgacctccccgtgtggctggcctacaaggtggccgccgaggggatcaactacgcggaccgcaagtggtgcttcgacggcatcaagaacaaccagatcctggaggagaacgtcgaggtggagatctggaccaaggagggcgagcggaagaagctcaagccgcgctggctggacgcccggatctacagcgaccccctggccctcaaggagttcaaggagttcgccgcggggcgcaagtccctgaccctgaacctcatcaccgagatgggccggctgcccacgttcatgacccagaaggcccgcaacgccctggacaacctcgccgtgctgcacaccgccgaggccggcgggcgggcctacaaccacgccctgagcgagctccccgagaccctggagacgctgctcctgctgaccctcctggccaccgtcaccggcgggatcttcctgttcctcatgtccgggaaggggatcggcaagatgaccctggggatgtgctgcatcatcacggccagcgtgctgctctggtacgcgcagatccagccgcactggatcgccgcctccatcatcctggagttcttcctgatcgtcctcctgatccccgagcccgagaagcagcgcacgccccaggacaaccagctgacctacgtggtgatcgccatcctcaccgtcgtggccgcgacgatggccaacgagatgggcttcctggagaagaccaagaaggacctgggcctcgggagcatcaccacccaggagagcgagtccaacatcctggacatcgacctgcggccggccagcgcctggacgctctacgccgtggcgaccaccttcgtcacccccatgctgcgccactccatcgagaacagctccgtgaacgtgagcctgacggccatcgccaaccaggccaccgtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcggccccgggctgcaggcgaaggccacgcgggaggcccagaagcgcgccgccgcgggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcggacgacctgggccctgtgcgaggccctcaccctggccaccgggcccatctccacgctgtgggagggcaaccccggccgcttctggaacaccaccatcgccgtcagcatggcgaacatcttccgcgggtcctacctcgccggcgccgggctgctgttcagcatcatgaagaacaccacgaacacccggcgcggcaccggcaacatcggggagaccctcggcgagaagtggaagtcccggctgaacgccctgggcaagagcgagttccagatctacaagaagtccggcatccaggaggtggaccgcacgctcgcgaaggaggggatcaagcggggcgagaccgaccaccacgccgtgagccgcggctccgccaagctgcggtggttcgtcgagcgcaacatggtgaccccggaggggaaggtggtcgacctgggctgcgggcggggcgggtggagctactactgcggcggcctcaagaacgtgcgcgaggtgaaggggctgaccaagggcgggcccggccacgaggagcccatccccatgtccacgtacgggtggaacctggtccggctccagagcggcgtggacgtgttcttcaccccgcccgagaagtgcgacaccctgctgtgcgacatcggcgagagctcccccaaccccaccatcgaggccgggcgcaccctccgggtcctgaacctggtggagaactggctcaacaacaacacgcagttctgcatcaaggtgctgaacccgtacatgcccagcgtcatcgagaagatggagaccctgcagcgcaagtacggcggggccctcgtgcggaaccccctgtcccgcaacagcacccacgagatgtactgggtgtccaacgcgaccggcaacatcgtcagctccgtgaacatgatcagccggatgctgatcaaccgcttcacgatgaagcacaagaaggccacctacgagccggacgtggacctggggtccggcacccggaacatcggcatcgagagcgagatccccaacctcgacatcatcgggaagcgcatcgagaagatcaagcaggagcacgagacctcctggcactacgaccaggaccacccctacaagacgtgggcctaccacggcagctacgagaccaagcagaccgggtccgccagctccatggtcaacggcgtggtgcgcctgctgaccaagccctgggacgtcgtgccgatggtgacgcagatggccatgaccgacaccacccccttcggccagcagcgggtcttcaaggagaaggtggacacgcgcacccaggagcccaaggaggggaccaagaagctcatgcggatcaccgcggagtggctgtggaaggagctgggcaagaagaagacgccccgcatgtgcacccgggaggagttcacccgcaaggtgcggagcaacgccgccctcggggccatcttcaccgacgagaacaagtggaagtccgcccgcgaggcggtcgaggacggccggttctgggagctggtggacaaggagcgcaacctgcacctcgaggggaagtgcgagacgtgcgtgtacaacatgatgggcaagcgggagaagaagctgggcgagttcgggaaggccaagggcagccgcgccatctggtacatgtggctgggggcccggttcctcgagttcgaggcgctgggcttcctgaacgaggaccactggttctcccgcgggaacagcctcagcggcgtcgagggcgaggggctgcaccggctgggctacatcctccgcgacgtggggaagaaggagggcggggccatgtacgccgacgacaccgccggctgggacacccggatcaccctggaggacctgaagaacgaggagatggtcacgaaccacatgaagggcgagcacaagaagctcgccgaggcgatcttcaagctgacctaccagaacaaggtggtgcgcgtccagcggccgacgccccgcgggaccgtgatggacatcatctcccggcgcgaccagcgcggcagcggccaggtggggacgtacggcctgaacaccttcaccaacatggaggcccagctcatccggcagatggagggggagggcatcttcaagtccatccagcacctgaccgccacggaggagatcgccgtccagaactggctggcccgcgtggggcgggagcgcctcagccggatggcgatctccggcgacgactgcgtggtcaagcccatcgacgaccgcttcgccagcgccctgaccgccctgaacgacatggggaaggtgcggaaggacatccagcagtgggagccctcccgcggctggaacgactggacccaggtgccgttctgcagccaccacttccacgagctcgtcatgaaggacggccgggtgctggtggtcccctgccgcaaccaggacgagctgatcgggcgggcccgcatctcccagggcgcggggtggagcctcaaggagaccgcctgcctgggcaagtcctacgcccagatgtggaccctgatgtacttccaccggcgcgacctccggctggccgccaacgcgatctgcagcgccgtgccctcccactgggtgcccacgagccgcaccacctggtccatccacgccaagcacgagtggatgaccacggaggacatgctggccgtctggaaccgggtgtggatccaggagaacccgtggatggaggacaagacccccgtggagagctgggaggaggtcccctacctcgggaagcgcgaggaccagtggtgcggctccctgatcggcctgaccagccgggcgacctgggccaagaacatccagacggccatcaaccaggtgcgcagcctcatcgggaacgaggagtacaccgactacatgccctccatgaagcgcttccggcgcgaggaggaggaggccggcgtgctgtggtga

SEQ ID NO: 9770 - RNA, 9876 nt, synthetic construct
  misc_feature 1..9876: note = derived and/or modified CDS sequence (opt1) from DENV-2__HQ332185__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagatcaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaagaacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtcctgaagatcgtgcgcaacatggagaagtaccagctcgccgtgaccatcatggccatctcctgcgtcccgaacgccgtgatcctgcggaacgcctggaaggtgagctgcaccatcctggcggccgtctccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtcggcatggtgagcatcctcgcctccagcctgctgaagaacgacatccccatgaccgggcccctcgtggccggcgggctgctgaccgtctgctacgtgctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtcatcagcggggtgttcccggtgtccatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgcgggggtgtacaaggagggcacgttccacaccatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagacgaacaccgggaccatcggcgcggtgagcctggacttctcccccggcaccagcgggtcccccatcgtcgaccgcaagggcaaggtggtggggctctacggcaacggcgtcgtgacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcacgctgatcctggccccgacccgggtggtggccgcggagatggaggaggccctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcgcacttcaccgaccccgcctccatcgccgcccggggctacatcagcacccgcgtcgagatgggggaggccgcgggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgcggggcccatgccggtgacccactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgcgatcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtggagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtcctgcacaccgccgaggcgggcgggcgggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcgcagatccagccgcactggatcgccgcctccatcatcctggagttcttcctgatcgtgctcctgatccccgagcccgagaagcagcgcacgccccaggacaaccagctgacctacgtggtcatcgccatcctcaccgtggtggccgcgaccatggccaacgagatggggttcctggagaagacgaagaaggacctgggcctcggcagcatcaccacccaggagagcgagtccaacatcctggacatcgacctgcggccggccagcgcctggaccctctacgccgtcgcgacgaccttcgtgacccccatgctgcgccactccatcgagaacagctccgtgaacgtcagcctgaccgccatcgccaaccaggccacggtgctcatggggctgggcaaggggtggcccctgtccaagatggacatcggcgtgcccctcctggcgatcgggtgctacagccaggtcaacccgatcaccctgaccgccgccctcctgctgctcgtggcccactacgccatcatcggccccggcctgcaggcgaaggccacccgggaggcccagaagcgcgccgccgcggggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcggaccacgtgggccctgtgcgaggccctcaccctggccaccggccccatctccaccctgtgggaggggaaccccggccgcttctggaacacgaccatcgccgtgagcatggcgaacatcttccgcggctcctacctcgccggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgcgaaggagggcatcaagcgcggggagacggaccaccacgccgtcagccgcggctccgccaagctgcggtggttcgtggagcgcaacatggtgaccccggagggcaaggtcgtggacctggggtgcggccgcggcgggtggagctactactgcggcgggctcaagaacgtgcgcgaggtcaaggggctgaccaagggcggccccgggcacgaggagcccatccccatgtccacctacggctggaacctggtgcggctccagagcggggtggacgtcttcttcacgccgcccgagaagtgcgacaccctgctgtgcgacatcggcgagagctcccccaaccccaccatcgaggccggccgcaccctccgggtgctgaacctggtggagaactggctcaacaacaacacccagttctgcatcaaggtcctgaacccgtacatgcccagcgtgatcgagaagatggagacgctgcagcgcaagtacgggggcgccctcgtgcggaaccccctgtcccgcaacagcacccacgagatgtactgggtctccaacgcgaccgggaacatcgtgagctccgtgaacatgatcagccggatgctgatcaaccgcttcaccatgaagcacaagaaggccacgtacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgcggagtggctgtggaaggagctggggaagaagaagacgccccggatgtgcacgcgggaggagttcacccgcaaggtccggagcaacgccgccctcggcgccatcttcaccgacgagaacaagtggaagtccgcccgcgaggcggtggaggacgggcggttctgggagctggtggacaaggagcgcaacctgcacctcgagggcaagtgcgagacctgcgtctacaacatgatggggaagcgggagaagaagctgggcgagttcggcaaggccaaggggagccgcgccatctggtacatgtggctgggcgcccggttcctcgagttcgaggcgctggggttcctgaacgaggaccactggttctcccgcggcaacagcctcagcggggtggagggcgagggcctgcaccggctggggtacatcctccgcgacgtcggcaagaaggagggcggcgccatgtacgccgacgacacggccgggtgggacacccggatcaccctggaggacctgaagaacgaggagatggtgaccaaccacatgaagggcgagcacaagaagctcgccgaggcgatcttcaagctgacgtaccagaacaaggtggtccgcgtgcagcggccgacgccccgcggcaccgtgatggacatcatctcccggcgcgaccagcgcgggagcggccaggtcgggacctacggcctgaacacgttcaccaacatggaggcccagctcatccggcagatggagggcgaggggatcttcaagtccatccagcacctgaccgccaccgaggagatcgccgtgcagaactggctggcccgcgtgggccgggagcgcctcagccggatggcgatctccggggacgactgcgtcgtgaagcccatcgacgaccgcttcgccagcgccctgacggccctgaacgacatgggcaaggtgcggaaggacatccagcagtgggagccctcccgcgggtggaacgactggacccaggtcccgttctgcagccaccacttccacgagctcgtgatgaaggacggccgggtgctggtcgtgccctgccgcaaccaggacgagctgatcggccgggcccgcatctcccagggggcgggctggagcctcaaggagaccgcctgcctggggaagtcctacgcccagatgtggaccctgatgtacttccaccggcgcgacctccggctggccgccaacgcgatctgcagcgccgtgccctcccactgggtccccaccagccgcacgacctggtccatccacgccaagcacgagtggatgaccaccgaggacatgctggccgtgtggaaccgggtgtggatccaggagaacccgtggatggaggacaagacgcccgtcgagagctgggaggaggtgccctacctcggcaagcgcgaggaccagtggtgcgggtccctgatcggcctgaccagccgggcgacctgggccaagaacatccagaccgccatcaaccaggtgcgcagcctcatcggcaacgaggagtacacggactacatgccctccatgaagcgcttccggcgcgaggaggaggaggccggggtcctgtggtga

SEQ ID NO: 9771 - RNA, 9876 nt, synthetic construct
  misc_feature 1..9876: note = derived and/or modified CDS sequence (opt1) from DENV-2__HQ332186__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagagccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccttctggtccaacggcgtcctggagagcgagatgatcatccccaagaacttcgccgggcccgtgtcccagcacaactaccgcccgggctaccacacgcagatcgcggggccctggcacctgggcaagctcgagatggacttcgacttctgcgaggggaccaccgtggtcgtgaccgaggactgcggcaaccggggccccagcctgcgcacgaccaccgccagcgggaagctgatcaccgagtggtgctgccggtcctgcacgctcccgcccctgcgctaccggggcgaggacgggtgctggtacggcatggagatccgccccctgaaggagaaggaggagaacctcgtgaacagcctggtcaccgccgggcacggccagatcgacaacttctccctgggcgtgctcgggatggccctgttcctggaggagatgctccggacccgcgtgggcaccaagcacgcgatcctgctggtcgccgtgagcttcgtgacgctcatcaccgggaacatgtccttccgggacctgggccgcgtcatggtgatggtgggggccaccatgaccgacgacatcggcatgggcgtcacgtacctggccctcctggccgcgttcaaggtgcgccccaccttcgccgccgggctgctcctgcggaagctgaccagcaaggagctcatgatggccaccatcggcatcacgctgctgtcccagagcaccatccccgagaccatcctcgagctgaccgacgccctggcgctcgggatgatggtgctgaagatcgtccgcaacatggagaagtaccagctggccgtgacgatcatggccatctcctgcgtgcccaacgccgtcatcctccggaacgcctggaaggtgagctgcaccatcctggcggccgtctccgtgagccccctgctcctgacctccagccagcagaaggccgactggatccccctggccctcaccatcaagggcctgaaccccacggcgatcttcctgaccaccctctcccgcaccagcaagaagcggtcctggccgctgaacgaggccatcatggccgtgggcatggtcagcatcctggcctccagcctcctgaagaacgacatccccatgacggggcccctggtggccggcgggctcctgaccgtgtgctacgtcctgaccggccgcagcgcggacctcgagctggagcgggccgccgacgtgaagtgggaggaccaggccgagatctccgggagctcccccatcctgagcatcaccatctccgaggacggcagcatgtccatcaagaacgaggaggaggagcagacgctcaccatcctgatccgcaccggcctgctcgtgatcagcggggtcttcccggtgtccatccccatcaccgccgcggcctggtacctgtgggaggtgaagaagcagcgggccggcgtcctgtgggacgtgccctccccgccgcccgtggggaaggccgagctcgaggacggcgcctaccgcatcaagcagcgggggatcctgggctactcccagatcggcgcgggggtctacaaggagggcaccttccacacgatgtggcacgtgacccgcggggccgtgctgatgcaccggggcaagcgcatcgagcccagctgggccgacgtcaagaaggacctcatctcctacgggggcggctggaagctggagggggagtggaaggagggcgaggaggtccaggtgctggccctcgagcccgggaagaacccccgggccgtccagaccaagcccggcatcttcaagaccaacacggggaccatcggcgcggtgagcctggacttctcccccggcaccagcgggtcccccatcgtggaccgcaagggcaaggtcgtggggctgtacggcaacggcgtggtcacccggagcggggcctacgtgtccgccatcgcccagacggagaagtccatcgaggacaaccccgagatcgaggacgacatcttccgcaagaagcggctcaccatcatggacctgcaccccggcgcggggaagaccaagcgctacctgcccgccatcgtgcgggaggccatcaagcgcggcctccgcaccctgatcctggccccgacgcgggtcgtggccgcggagatggaggaggccctgcgcgggctccccatccggtaccagacccccgccatcaaggccgagcacaccggccgcgagatcgtggacctgatgtgccacgccaccttcacgatgcggctgctcagccccgtccgcgtgccgaactacaacctgatcatcatggacgaggcgcacttcaccgaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggccggcaacgacatcgcggcctgcctgcgcaagaacggcaagaaggtcatccagctcagccggaagaccttcgactccgagtacgtgaagacgcgcgccaacgactgggacttcgtggtcaccaccgacatcagcgagatgggggccaacttcaaggccgagcgggtgatcgacccccgccggtgcatgaagcccgtgatcctgaccgacggcgaggagcgcgtcatcctggcggggcccatgccggtgacgcactccagcgccgcccagcggcgcggccgcatcgggcggaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgcgagaaggtggacgcgatcgacggggagtaccggctccgcggcgaggcccggaagaccttcgtcgacctgatgcgccgcggggacctgcccgtgtggctcgcctacaaggtggccgccgagggcatcaactacgcggaccgcaagtggtgcttcgacgggatcaagaacaaccagatcctggaggagaacgtcgaggtggagatctggaccaaggagggcgagcggaagaagctgaagccgcgctggctcgacgcccggatctacagcgaccccctggccctgaaggagttcaaggagttcgccgcgggccgcaagtccctcacgctgaacctgatcaccgagatggggcggctccccaccttcatgacccagaaggcccgcaacgccctggacaacctggccgtcctccacacggccgaggcgggcgggcgggcctacaaccacgccctgagcgagctgcccgagaccctcgagaccctgctgctcctgaccctgctcgccacggtgaccggcggcatcttcctgttcctgatgtccgggaagggcatcgggaagatgaccctcggcatgtgctgcatcatcaccgccagcgtgctgctgtggtacgcgcagatccagccgcactggatcgccgcctccatcatcctcgagttcttcctgatcgtcctgctcatccccgagcccgagaagcagcgcacgccccaggacaaccagctgacgtacgtggtgatcgccatcctgaccgtcgtggccgcgaccatggccaacgagatggggttcctcgagaagaccaagaaggacctgggcctgggcagcatcacgacccaggagccggagagcaacatcctcgacatcgacctgcggcccgcctccgcctggaccctgtacgccgtggcgaccacgttcgtcacccccatgctccgccacagcatcgagaactccagcgtgaacgtgtccctgaccgccatcgccaaccaggccaccgtcctgatggggctcggcaaggggtggcccctgagcaagatggacatcggcgtgccgctgctcgcgatcgggtgctactcccaggtgaaccccatcacgctgaccgccgccctgctcctgctggtcgcccactacgccatcatcggccccggcctccaggcgaaggccacccgggaggcccagaagcgcgccgccgcggggatcatgaagaaccccaccgtggacggcatcacggtgatcgacctggagccgatcccctacgaccccaagttcgagaagcagctggggcaggtcatgctcctgatcctgtgcgtgacccaggtgctcatgatgcggaccacctgggccctgtgcgaggccctgacgctcgccaccggccccatcagcaccctgtgggaggggaacccgggccgcttctggaacaccacgatcgccgtctccatggcgaacatcttccgcggcagctacctggccggggccggcctcctgttctccatcatgaagaacaccaccaacacccggcgcgggacgggcaacatcggcgagaccctgggggagaagtggaagtcccggctcaacgccctgggcaagtccgagttccagatctacaagaagtccgggatccaggaggtggaccgcaccctggcgaaggagggcatcaagcgcggggagaccgaccaccacgccgtgtcccgcggcagcgccaagctccggtggttcgtcgagcgcaacatggtgacgcccgagggcaaggtggtcgacctggggtgcggccgcggcgggtggtcctactactgcggcgggctgaagaacgtgcgcgaggtgaaggggctcaccaagggcggccccgggcacgaggagcccatcccgatgagcacctacggctggaacctggtccggctgcagtccggggtggacgtgttcttcacgccgcccgagaagtgcgacacgctcctgtgcgacatcggcgagagcagccccaacccgaccatcgaggccggccgcaccctgcgggtcctcaacctggtggagaactggctgaacaacaacacccagttctgcatcaaggtgctcaacccctacatgccctccgtcatcgagaagatggagaccctgcagcgcaagtacgggggcgccctggtgcggaacccgctcagccgcaactccacgcacgagatgtactgggtgagcaacgcgaccgggaacatcgtctccagcgtgaacatgatctcccggatgctgatcaaccgcttcaccatgaagcacaagaaggccacctacgagcccgacgtggacctgggcagcgggacgcggaacatcggcatcgagtccgagatccccaacctggacatcatcggcaagcgcatcgagaagatcaagcaggagcacgagaccagctggcactacgaccaggaccacacctacaagacctgggcctaccacgggtcctacgagacgaagcagaccggcagcgcctccagcatggtcaacggggtggtgcgcctcctgaccaagccctgggacgtcgtgccgatggtgacccagatggccatgacggacaccacccccttcggccagcagcgggtcttcaaggagaaggtggacacccgcacgcaggagcccaaggagggcaccaagaagctgatgcggatcaccgcggagtggctctggaaggagctggggaagaagaagacgccccggatgtgcacgcgggaggagttcacccgcaaggtgcggtccaacgccgccctgggcgccatcttcaccgacgagaacaagtggaagtccgcccgcgaggcggtcgaggacgggcggttctgggagctcgtggaccgcgagcggaacctgcacctggagggcaagtgcgagacctgcgtctacaacatgatggggaagcgcgagaagaagctcggcgagttcggcaaggccaaggggtcccgggccatctggtacatgtggctgggcgcccgcttcctggagttcgaggcgctcgggttcctgaacgaggaccactggttcagccggggcaactccctgagcggggtggagggcgagggcctccaccgcctggggtacatcctgcgggacgtgggcaagaaggagggcggcgccatgtacgccgacgacacggccgggtgggacacccgcatcaccctcgaggacctgaagaacgaggagatggtcaccaaccacatgaagggcgagcacaagaagctggccgaggcgatcttcaagctcacgtaccagaacaaggtggtgcgggtccagcgcccgacgccccggggcaccgtgatggacatcatcagccgccgcgaccagcgggggtccggccaggtggggacctacggcctgaacaccttcaccaacatggaggcccagctgatccgccagatggagggcgaggggatcttcaagagcatccagcacctcaccgtcaccgaggagatcgccgtgcagaactggctggcccgggtgggccgcgagcggctgtcccgcatggccatcagcggggacgactgcgtcgtgaagcccatcgacgaccggttcgcgtccgccctcacggccctgaacgacatgggcaaggtgcgcaaggacatccagcagtgggagcccagccgggggtggaacgactggacccaggtcccgttctgctcccaccacttccacgagctggtgatgaaggacggccgcgtgctcgtcgtgccctgccggaaccaggacgagctgatcggccgcgcccggatcagccagggggccggctggtccctgaaggagaccgcgtgcctcggcaagagctacgcccagatgtggaccctgatgtacttccaccgccgggacctgcgcctcgccgccaacgccatctgctccgcggtgcccagccactgggtccccacctcccggacgacctggagcatccacgccaagcacgagtggatgaccaccgaggacatgctggccgtgtggaaccgcgtgtggatccaggagaacccgtggatggaggacaagacgcccgtcgagtcctgggaggaggtgccctacctgggcaagcgggaggaccagtggtgcgggagcctcatcggcctgacctcccgcgccacctgggcgaagaacatccagaccgccatcaaccaggtgcgcagcctgatcggcaacgaggagtacacggactacatgcccagcatgaagcggttccgccgggaggaggaggaggccggggtcctctggtga

SEQ ID NO: 9772 - RNA, 9876 nt, synthetic construct
  misc_feature 1..9876: note = derived and/or modified CDS sequence (opt1) from DENV-2__HQ332187__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcatccagtacgagggcgacggctccccctgcaagatccccttcgagatcaccgacctggagaagcggcacgtgctcgggcgcctgatcaccgtcaacccgatcgtgatcgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggaccatgaagatcctgatcggcgtggtgatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacaccaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatgatcctgaagatcgtccgcaacatggagaagtaccagctcgccgtgaccatcatggccatctcctgcgtgccgaacgccgtcatcctgcggaacgcctggaaggtgagctgcaccatcctggcggccgtgtccgtcagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtgggcatggtcagcatcctcgcctccagcctgctgaagaacgacatccccatgaccgggcccctcgtggccggcgggctgctgaccgtgtgctacgtcctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtgatcagcggggtcttcccggtgtccatccccatcaccgccgcggcctggtacctgtgggaggtgaagaagcagcgggccggcgtcctctgggacgtgcccagcccgccgcccgtggggaaggccgagctggaggacggcgcctaccgcatcaagcagcgggggatcctgggctactcccagatcggcgcgggggtctacaaggagggcacgttccacaccatgtggcacgtgacccgcggggccgtgctcatgcaccggggcaagcgcatcgagcccagctgggccgacgtcaagaaggacctgatctcctacgggggcggctggaagctggagggggagtggaaggagggcgaggaggtccaggtgctcgccctggagcccgggaagaacccccgggccgtccagaccaagcccggcatcttcaagacgaacaccgggaccatcggcgcggtgagcctggacttctcccccggcaccagcgggtcccccatcgtggaccgcaagggcaaggtcgtggggctctacggcaacggcgtggtcacgcggagcggggcctacgtgtccgccatcgcccagaccgagaagtccatcgaggacaaccccgagatcgaggacgacatcttccgcaagaagcggctgaccatcatggacctgcaccccggcgcggggaagaccaagcgctacctccccgtgatcgtccgggaggccatcaagcgcggcctgcgcacgctgatcctggccccgacccgggtggtggccgccgagatggaggaggcgctccgcgggctgcccatccggtaccagacccccgccatcaaggccgagcacaccggccgcgagatcgtcgacctgatgtgccacgccacgttcaccatgcggctcctgagccccgtgcgcgtgccgaactacaacctgatcatcatggacgaggcccacttcaccgaccccgcgtccatcgccgcccggggctacatcagcacccgcgtcgagatgggggaggccgccggcatcttcatgacggcgacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgccgcgtgcctccgcaagaacggcaagaaggtgatccagctgagccggaagacgttcgactccgagtacgtgaagacccgcgccaacgactgggacttcgtcgtgaccaccgacatcagcgagatgggggccaacttcaaggccgagcgggtgatcgacccccgccggtgcatgaagcccgtcatcctgacggacggcgaggagcgcgtgatcctcgccgggcccatgccggtgacccactccagcgcggcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgccatcgacggggagtaccggctgcgcggcgaggcgcggaagaccttcgtggacctgatgcgccgcggggacctccccgtgtggctggcctacaaggtcgccgccgagggcatcaactacgccgaccgcaagtggtgcttcgacgggatcaagaacaaccagatcctggaggagaacgtggaggtggagatctggacgaaggagggcgagcggaagaagctcaagccgcgctggctggacgcgcggatctacagcgaccccctggccctcaaggagttcaaggagttcgccgccggccgcaagtccctgaccctgaacctcatcaccgagatggggcggctgcccaccttcatgacgcagaaggcgcgcaacgccctggacaacctcgccgtcctgcacaccgccgaggccggcgggcgggcgtacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcgtcctgctctggtacgcccagatccagccgcactggatcgcggcctccatcatcctggagttcttcctgatcgtgctcctgatccccgagcccgagaagcagcgcacgccccaggacaaccagctgacctacgtggtcatcgccatcctcaccgtggtggccgccaccatggcgaacgagatggggttcctggagaagacgaagaaggacctgggcctcggcagcatcaccacccaggagagcgagtccaacatcctggacatcgacctgcggccggccagcgcctggaccctctacgccgtcgccacgaccttcgtgacccccatgctgcgccactccatcgagaacagctccgtgaacgtcagcctgaccgcgatcgccaaccaggccacggtgctcatggggctgggcaaggggtggcccctgtccaagatggacatcggcgtgcccctcctggccatcgggtgctacagccaggtcaacccgatcaccctgaccgcggccctcctgctgctcgtggcccactacgccatcatcggccccggcctgcaggccaaggcgacccgggaggcccagaagcgcgccgccgccgggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcggaccacgtgggcgctgtgcgaggccctcaccctggccaccggccccatctccaccctgtgggaggggaaccccggccgcttctggaacacgaccatcgccgtgagcatggccaacatcttccgcggctcctacctcgcgggggccggcctgctgttcagcatcatgaagaacaccaccaacacgcggcgcgggaccggcaacatcggcgagaccctcggggagaagtggaagtcccggctgaacgccctgggcaagagcgagttccagatctacaagaagtccgggatccaggaggtggaccgcaccctcgccaaggagggcatcaagcgcggggagacggaccaccacgcggtcagccgcggctccgccaagctgcggtggttcgtggagcgcaacatggtgaccccggagggcaaggtcgtggacctggggtgcggccgcgggggctggagctactactgcgggggcctcaagaacgtgcgcgaggtcaagggcctgaccaagggcggccccgggcacgaggagcccatccccatgtccacctacggctggaacctggtgcggctccagagcggggtggacgtcttcttcacgccgcccgagaagtgcgacaccctgctgtgcgacatcggcgagagctcccccaaccccaccatcgaggccggccgcaccctccgggtgctgaacctggtggagaactggctcaacaacaacacccagttctgcatcaaggtcctgaacccgtacatgcccagcgtgatcgagaagatggagacgctgcagcgcaagtacgggggcgccctcgtgcggaaccccctgtcccgcaacagcacccacgagatgtactgggtctccaacgccaccgggaacatcgtgagctccgtgaacatgatcagccggatgctgatcaaccgcttcaccatgaagcacaagaaggcgacgtacgagccggacgtcgacctgggctccgggacccggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctgaccaagccctgggacgtggtgccgatggtcacccagatggccatgacggacaccacccccttcggccagcagcgggtgttcaaggagaaggtggacacccgcacgcaggagcccaaggagggcaccaagaagctcatgcggatcaccgccgagtggctgtggaaggagctggggaagaagaagacgccccggatgtgcacgcgggaggagttcacccgcaaggtccggagcaacgcggccctcggcgccatcttcaccgacgagaacaagtggaagtccgcccgcgaggccgtggaggacgggcggttcggcgagctggtggacaaggagcgcaacctgcacctcgaggggaagtgcgagacctgcgtctacaacatgatgggcaagcgggagaagaagctgggcgagttcgggaaggcgaagggcagccgcgccatctggtacatgtggctgggggcccggttcctcgagttcgaggccctgggcttcctgaacgaggaccactggttctcccgcgggaacagcctcagcggcgtggagggcgaggggctgcaccggctgggctacatcctccgcgacgtcgggaagaaggagggcggggcgatgtacgccgacgacacggccggctgggacacccggatcaccctggaggacctgaagaacgaggagatggtgaccaaccacatgaagggcgagcacaagaagctcgccgaggccatcttcaagctgacgtaccagaacaaggtggtccgcgtgcagcggccgacgccccgcgggaccgtgatggacatcatctcccggcgcgaccagcgcggcagcgggcaggtcggcacctacggcctgaacacgttcaccaacatggaggcgcagctcatccggcagatggagggggagggcatcttcaagtccatccagcacctgaccgccaccgaggagatcgccgtgcagaactggctggcccgcgtggggcgggagcgcctcagccggatggccatctccggcgacgactgcgtcgtgaagcccatcgacgaccgcttcgcgagcgccctgacggccctgaacgacatggggaaggtgcggaaggacatccagcagtgggagccctcccgcggctggaacgactggacccaggtcccgttctgcagccaccacttccacgagctcgtgatgaaggacggccgggtgctggtcgtgccctgccgcaaccaggacgagctgatcgggcgggcccgcatctcccagggcgccgggtggagcctcaaggagaccgcgtgcctgggcaagtcctacgcccagatgtggaccctgatgtacttccaccggcgcgacctccggctggccgccaacgccatctgcagcgcggtgccctcccactgggtccccaccagccgcacgacctggtccatccacgccaagcacgagtggatgaccaccgaggacatgctggccgtgtggaaccgggtgtggatccaggagaacccgtggatggaggacaagacgcccgtcgagagctgggaggaggtgccctacctcgggaagcgcgaggaccagtggtgcggctccctgatcggcctgaccagccgggccacctgggcgaagaacatccagaccgccatcaaccaggtgcgcagcctcatcgggaacgaggagtacacggactacatgccctccatgaagcgcttccggcgcgaggaggaggaggccggcgtcctgtggtga

SEQ ID NO: 9773 - RNA, 9876 nt, synthetic construct
  misc_feature 1..9876: note = derived and/or modified CDS sequence (opt1) from DENV-2__HQ332188__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagcagcgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggaccatgaagatcctgatcggcgtcgtgatcacgtggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacaccaagggggtgatgcaggccggcaagcggagcctgcgcccgcagcccaccgagctgaagtactcctggaagacgtggggcaaggcgaagatgctcagcaccgagtcccacaaccagaccttcctgatcgacgggcccgagaccacggagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggccgtgcacgcggacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagatcgccgggccctggcacctcggcaagctggagatggacttcgacttctgcgaggggaccaccgtcgtggtgacggaggactgcggcaaccggggccccagcctgcgcaccaccaccgcgagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcacgaagcacgccatcctgctcgtggcggtgagcttcgtcaccctgatcaccgggaacatgtccttccgggacctgggccgcgtgatggtgatggtcggggccaccatgacggacgacatcggcatgggcgccacctacctcgccctgctggccgcgttcaaggtgcgccccaccttcgccgccgggctcctgctgcggaagctcaccagcaaggagctgatgatggccacgatcggcatcaccctgctctcccagagcaccatccccgagaccatcctggagctgacggacgccctcgcgctggggatgatggtgctgaagatcgtccgcaacatggagaagtaccagctcgccgtgaccatcatggccatctcctgcgtgccgaacgccgtcatcctgcggaacgcctggaaggtgagctgcaccatcctggcggccgtctccgtgagccccctcctgctgacctccagccagcagaaggccgactggatccccctcgccctgacgatcaagggcctgaaccccaccgcgatcttcctcaccaccctgtcccgcacgagcaagaagcggtcctggccgctgaacgaggccatcatggccgtgggcatggtcagcatcctcgcctccagcctgctgaagaacgacatccccatgaccgggcccctcgtggccggcgggctgctgaccgtgtgctacgtcctcaccggccgcagcgcggacctggagctggagcgggccgccgacgtgaagtgggaggaccaggccgagatctccgggagctcccccatcctcagcatcacgatctccgaggacggcagcatgtccatcaagaacgaggaggaggagcagaccctgaccatcctgatccgcaccggcctcctggtgatcagcggggtcttcccggtgtccatccccatcaccgccgcggcctggtacctgtgggaggtgaagaagcagcgggccggcgtcctctgggacgtgcccagcccgccgcccgtggggaaggccgagctggaggacggcgcctaccgcatcaagcagcgggggatcctgggctactcccagatcggcgcgggggtctacaaggagggcacgttccacaccatgtggcacgtgacccgcggggccgtgctcatgcaccggggcaagcgcatcgagcccagctgggccgacgtcaagaaggacctgatctcctacgggggcggctggaagctggagggggagtggaaggagggcgaggagatccaggtgctcgccctggagcccgggaagaacccccgggccgtgcagaccaagcccggcatcttcaagacgaacaccgggaccatcggcgcggtcagcctggacttctcccccggcaccagcgggtcccccatcgtggaccgcaagggcaaggtggtcgggctctacggcaacggcgtggtgacgcggagcggggcctacgtctccgccatcgcccagaccgagaagtccatcgaggacaaccccgagatcgaggacgacatcttccgcaagaagcggctgaccatcatggacctgcaccccggcgcggggaagaccaagcgctacctccccgccatcgtgcgggaggccatcaagcgcggcctgcgcacgctgatcctggccccgacccgggtggtcgccgcggagatggaggaggccctccgcgggctgcccatccggtaccagacccccgccatcaaggccgagcacaccggccgcgagatcgtggacctgatgtgccacgccacgttcaccatgcggctcctgagccccgtgcgcgtcccgaactacaacctgatcatcatggacgaggcgcacttcaccgaccccgcctccatcgccgcccggggctacatcagcacccgcgtggagatgggggaggccgcgggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtctggttcgtgccgtccatcaaggccggcaacgacatcgcggcctgcctccgcaagaacggcaagaaggtgatccagctgagccggaagacgttcgactccgagtacgtcaagacccgcgccaacgactgggacttcgtggtgaccaccgacatcagcgagatgggggccaacttcaaggccgagcgggtcatcgacccccgccggtgcatgaagcccgtgatcctgacggacggcgaggagcgcgtgatcctcgcggggcccatgccggtcacccactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtggacgcgatcgacggggagtaccggctgcgcggcgaggcccggaagaccttcgtggacctgatgcgccgcggggacctccccgtctggctggcctacaaggtggccgccgagggcatcaactacgcggaccgcaagtggtgcttcgacgggatcaagaacaaccagatcctggaggagaacgtggaggtcgagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtgctgcacaccgccgaggcgggcgggcgggcctacaaccacgccctgagcgagctccccgagaccctggagaccctgctcctgctgacgctcctggccaccgtcaccggcggcatcttcctgttcctcatgtccgggaagggcatcgggaagatgaccctgggcatgtgctgcatcatcaccgccagcgtgctgctctggtacgcgcagatccagccgcactggatcgccgcctccatcatcctggagttcttcctgatcgtgctcctgatccccgagcccgagaagcagcgcacgccccaggacaaccagctgacctacgtcgtgatcgccatcctcaccgtggtcgccgcgaccatggccaacgagatggggttcctggagaagacgaagaaggacctgggcctcggcagcatcaccacccaggagccggagagcaacatcctggacatcgacctgcggcccgcctccgcctggaccctctacgccgtggcgacgaccttcgtgacccccatgctgcgccacagcatcgagaactccagcgtcaacgtgtccctgaccgccatcgccaaccaggccacggtgctcatggggctgggcaaggggtggcccctgagcaagatggacatcggcgtcccgctcctggcgatcgggtgctactcccaggtgaaccccatcaccctgaccgccgccctcctgctgctcgtggcccactacgccatcatcggccccggcctgcaggcgaaggccacccgggaggcccagaagcgcgccgccgcggggatcatgaagaaccccacggtcgacggcatcaccgtgatcgacctggagccgatcccctacgaccccaagttcgagaagcagctcgggcaggtcatgctgctgatcctctgcgtcacccaggtgctgatgatgcggaccacgtgggccctgtgcgaggccctcaccctggccaccggccccatcagcaccctgtgggaggggaacccgggccgcttctggaacacgaccatcgccgtgtccatggcgaacatcttccgcggcagctacctcgccggggccggcctgctgttctccatcatgaagaacaccaccaacacgcggcgcgggaccggcaacatcggcgagaccctcggggagaagtggaagtcccggctgaacgccctgggcaagtccgagttccagatctacaagaagtccgggatccaggaggtcgaccgcaccctcgcgaaggagggcatcaagcgcggggagacggaccaccacgccgtgtcccgcggcagcgccaagctgcggtggttcgtggagcgcaacatggtcacccccgagggcaaggtggtggacctggggtgcggccgcggcgggtggtcctactactgcggcgggctcaagaacgtccgcgaggtgaaggggctgaccaagggcggccccgggcacgaggagcccatcccgatgagcacctacggctggaacctggtgcggctccagtccggggtcgacgtgttcttcacgccgcccgagaagtgcgacaccctgctgtgcgacatcggcgagagcagccccaacccgaccatcgaggccggccgcaccctccgggtgctgaacctggtcgagaactggctcaacaacaacacccagttctgcatcaaggtgctgaacccctacatgccctccgtgatcgagaagatggagacgctgcagcgcaagtacgggggcgccctcgtccggaacccgctgagccgcaactccacccacgagatgtactgggtgagcaacgcgaccgggaacatcgtgtccagcgtcaacatgatctcccggatgctgatcaaccgcttcaccatgaagcacaagaaggccacgtacgagcccgacgtggacctgggcagcgggacccggaacatcggcatcgagtccgagatccccaacctcgacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtcgtgcgcctgctgaccaagccgtgggacgtggtccccatggtgacccagatggccatgacggacaccacccccttcggccagcagcgggtgttcaaggagaaggtcgacacccgcacgcaggagcccaaggagggcaccaagaagctcatgcggatcaccgcggagtggctgtggaaggagctggggaagaagaagaccccgcgcatgtgcacgcgggaggagttcacccgcaaggtgcggtccaacgccgccctcggcgccatcttcaccgacgagaacaagtggaagtccgcccgcgaggcggtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggtcccgggccatctggtacatgtggctgggcgcccgcttcctcgagttcgaggcgctggggttcctgaacgaggaccactggttcagccggggcaactccctcagcggggtcgagggcgagggcctgcaccgcctggggtacatcctccgggacgtgggcaagaaggagggcggcgccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagaacaaggtcgtgcgggtgcagcgccccacgccccggggcaccgtcatggacatcatcagccgccgcgaccagcgggggtccggccaggtggggacctacggcctgaacacgttcaccaacatggaggcccagctcatccgccagatggagggcgaggggatcttcaagagcatccagcacctgaccgtgaccgaggagatcgccgtccagaactggctggcccgggtgggccgcgagcggctctcccgcatggccatcagcggggacgactgcgtggtcaagcccatcgacgaccggttcgcgtccgccctgacggccctgaacgacatgggcaaggtgcgcaaggacatccagcagtgggagccgagccgggggtggaacgactggacccaggtgcccttctgctcccaccacttccacgagctcgtcatgaaggacggccgcgtgctggtggtcccctgccggaaccaggacgagctgatcggccgcgcccggatcagccagggggccggctggtccctcaaggagaccgcgtgcctgggcaagagctacgcccagatgtggaccctgatgtacttccaccgccgggacctccgcctggccgccaacgccatctgctccgcggtgcccagccactgggtgccgacctcccggacgacctggagcatccacgccaagcacgagtggatgaccaccgaggacatgctggccgtctggaaccgcgtgtggatccaggagaacccctggatggaggacaagacgcccgtggagtcctgggaggaggtcccctacctcggcaagcgggaggaccagtggtgcgggagcctgatcggcctgacctcccgcgccacctgggcgaagaacatccagaccgccatcaaccaggtgcgcagcctcatcggcaacgaggagtacacggactacatgccgagcatgaagcggttccgccgggaggaggaggaggccggggtgctgtggtga

SEQ ID NO: 9774 - RNA, 9876 nt, synthetic construct
  misc_feature 1..9876: note = derived and/or modified CDS sequence (opt1) from DENV-2__HQ332189__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagaactggatcctgcgccacccgggcttcaccatcatggccgcgatcctggcctacaccatcgggaccacccacttccagcgggccctcatcttcatcctgctgacggccgtggcgcccagcatgaccatgcgctgcatcggcatctccaaccgggacttcgtcgagggcgtgagcgggggctcctgggtggacatcgtcctcgagcacgggagctgcgtgaccaccatggccaagaacaagcccacgctggacttcgagctgatcaagaccgaggccaagcagcccgccaccctccgcaagtactgcatcgaggccaagctgaccaacacgaccaccgagtcccggtgcccgacccagggcgagcccagcctgaacgaggagcaggacaagcgcttcatctgcaagcactccatggtggaccggggctgggggaacggctgcgggctgttcggcaagggcgggatcgtcacgtgcgcgatgttcacgtgcaagaagaacatggagggcaaggtggtgcagcccgagaacctggagtacaccatcgtcatcacgccccacagcggggaggagcacgccgtgggcaacgacacggggaagcacggcaaggagatcaagatcaccccgcagtccagcatcaccgaggccgagctgaccgggtacggcaccgtgacgatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagaccctggtgacgttcaagaacccccacgcgaagaagcaggacgtcgtggtcctcgggtcccaggagggcgccatgcacaccgccctgaccggggccaccgagatccagatgagcagcggcaacctcctgttcacgggccacctgaagtgccgcctgcggatggacaagctccagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcacggacctggagaagcggcacgtgctcgggcgcctgatcaccgtgaacccgatcgtcatcgagaaggacagccccgtgaacatcgaggcggagccgcccttcggcgactcctacgtgatcatcggggtcgagccgggccagctgaagctcaactggttcaagaaggggagctccatcggccagatgttcgagaccaccatgcgcggcgccaagcggatggccatcctgggggacacggcctgggacttcggcagcctcggcggggtgttcacctccatcgggaaggccctccaccaggtgttcggggcgatctacggcgccgccttcagcggggtctcctggaccatgaagatcctgatcggcgtggtgatcacctggatcgggatgaacagccgctccacgagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcaccatcatgacgggcgacaccaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtcgtggtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgtggccgtgagcttcgtcacgctgatcaccgggaacatgtccttccgggacctgggccgcgtgatggtgatggtcggggccaccatgaccgacgacatcggcatgggcgtgacgtacctcgccctgctggccgcgttcaaggtgcgccccaccttcgccgccgggctcctgctgcggaagctcaccagcaaggagctgatgatggccaccatcggcatcacgctgctctcccagagcaccatccccgagaccatcctggagctgaccgacgccctcgcgctggggatgatggtcctgaagatcgtgcgcaacatggagaagtaccagctcgccgtgacgatcatggccatctcctgcgtcccgaacgccgtgatcctgcggaacgcctggaaggtcagctgcaccatcctggcggccgtgtccgtgagccccctcctgctgacctccagccagcagaaggccgactggatccccctcgccctgaccatcaagggcctgaaccccacggcgatcttcctcaccaccctgtcccgcaccagcaagaagcggtcctggccgctgaacgaggccatcatggccgtcggcatggtgagcatcctcgcctccagcctgctgaagaacgacatccccatgacggggcccctcgtggccggcgggctgctgaccgtctgctacgtgctcaccggccgcagcgcggacctggagctggagcgggccgccgacgtgaagtgggaggaccaggccgagatctccgggagctcccccatcctcagcatcaccatctccgaggacggcagcatgtccatcaagaacgaggaggaggagcagacgctgaccatcctgatccgcaccggcctcctggtcatcagcggggtgttcccggtgtccatccccatcaccgccgcggcctggtacctgtgggaggtcaagaagcagcgggccggcgtgctctgggacgtgcccagcccgccgcccgtcgggaaggccgagctggaggacggcgcctaccgcatcaagcagcgggggatcctgggctactcccagatcggcgcgggggtgtacaaggagggcaccttccacacgatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggccgtgcagaccaagcccggcatcttcaagaccaacacggggaccatcggcgcggtgagcctggacttctcccccggcaccagcgggtcccccatcgtcgaccgcaagggcaaggtggtggggctctacggcaacggcgtcgtgacccggagcggggcctacgtgtccgccatcgcccagacggagaagtccatcgaggacaaccccgagatcgaggacgacatcttccgcaagaagcggctgaccatcatggacctgcaccccggcgcggggaagaccaagcgctacctccccgccatcgtccgggaggccatcaagcgcggcctgcgcaccctgatcctggccccgacgcgggtggtggccgcggagatggaggaggccctccgcgggctgcccatccggtaccagacccccgccatcaaggccgagcacaccggccgcgagatcgtcgacctgatgtgccacgccaccttcacgatgcggctcctgagccccgtgcgcgtgccgaactacaacctgatcatcatggacgaggcgcacttcaccgaccccgcctccatcgccgcccggggctacatcagcacccgcgtcgagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctccgcaagaacggcaagaaggtgatccagctgagccggaagaccttcgactccgagtacgtgaagacgcgcgccaacgactgggacttcgtcgtgaccaccgacatcagcgagatgggggccaacttcaaggccgagcgggtgatcgacccccgccggtgcatgaagcccgtcatcctgaccgacggcgaggagcgcgtgatcctcgcggggcccatgccggtgacgcactccagcgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtcgacgcgatcgacggggagtaccggctgcgcggcgaggcccggaagaccttcgtggacctgatgcgccgcggggacctccccgtgtggctggcctacaaggtcgccgccgagggcatcaactacgcggaccgcaagtggtgcttcgacgggatcaagaacaaccagatcctggaggagaacgtggaggtcgagatctggaccaaggagggcgagcggaagaagctcaagccgcgctggctggacgcccggatctacagcgaccccctggccctcaaggagttcaaggagttcgccgcgggccgcaagtccctgacgctgaacctcatcaccgagatggggcggctgcccaccttcatgacccagaaggcccgcaacgccctggacaacctcgccgtgctgcacacggccgaggcgggcgggcgggcctacaaccacgccctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgccagcgtcctgctctggtacgcgcagatccagccgcactggatcgccgcctccatcatcctggagttcttcctgatcgtgctcctgatccccgagcccgagaagcagcgcacgccccaggacaaccagctgacgtacgtggtcatcgccatcctcaccgtggtggccgcgaccatggccaacgagatggggttcctggagaagaccaagaaggacctgggcctcggcagcatcacgacccaggagagcgagtccaacatcctggacatcgacctgcggccggccagcgcctggaccctctacgccgtcgcgaccacgttcgtgacccccatgctgcgccactccatcgagaacagctccgtgaacgtcagcctgaccgccatcgccaaccaggccaccgtgctcatggggctgggcaaggggtggcccctgtccaagatggacatcggcgtgcccctcctggcgatcgggtgctacagccaggtcaacccgatcacgctgaccgccgccctcctgctgctcgtggcccactacgccatcatcggccccggcctgcaggcgaaggccacccgggaggcccagaagcgcgccgccgcggggatcatgaagaaccccaccgtggacggcatcacggtcatcgacctggagcccatcccgtacgaccccaagttcgagaagcagctcggccaggtgatgctgctgatcctctgcgtgacccaggtcctgatgatgcggaccacctgggccctgtgcgaggccctcacgctggccaccggccccatctccaccctgtgggaggggaaccccggccgcttctggaacaccacgatcgccgtgagcatggcgaacatcttccgcggctcctacctcgccggggccggcctgctgttcagcatcatgaagaacaccaccaacacccggcgcgggacgggcaacatcggcgagaccctcggggagaagtggaagtcccggctgaacgccctgggcaagagcgagttccagatctacaagaagtccgggatccaggaggtggaccgcaccctcgcgaaggagggcatcaagcgcggggagaccgaccaccacgccgtcagccgcggctccgccaagctgcggtggttcgtggagcgcaacatggtgacgccggagggcaaggtcgtggacctggggtgcggccgcggcgggtggagctactactgcggcgggctcaagaacgtgcgcgaggtcaaggggctgaccaagggcgggcccgggcacgaggagcccatccccatgtccacctacggctggaacctggtgcggctccagagcggggtggacgtcttcttcaccccgcccgagaagtgcgacacgctgctgtgcgacatcggcgagagctcccccagccccaccatcgaggccggccgcaccctccgggtgctgaacctggtggaggactggctcaacaacaacacccagttctgcatcaaggtcctgaacccgtacatgccctccgtgatcgagaagatggagaccctgcagcgcaagtacgggggcgccctcgtgcggaaccccctgagccgcaactccacgcacgagatgtactgggtcagcaacgcgaccgggaacatcgtgtccagcgtgaacatgatctcccggatgctgatcaaccgcttcaccatgaagcacaagaaggccacctacgagccggacgtcgacctgggcagcgggacgcggaacatcggcatcgagtccgagatccccaacctcgacatcatcggcaagcgcatcgagaagatcaagcaggagcacgagaccagctggcactacgaccaggaccacacctacaagacctgggcctaccacgggtcctacgagacgaagcagaccggcagcgcctccagcatggtgaacggggtggtccgcctgctgaccaagccctgggacgtggtgcccatggtcacccagatggccatgacggacaccaccccgttcggccagcagcgggtgttcaaggagaaggtggacacccgcacgcaggagcccaaggagggcaccaagaagctcatgcggatcaccgcggagtggctgtggaaggagctggggaagaagaagacgccccggatgtgcacgcgggaggagttcacccgcaaggtccggtccaacgccgccctcggcgccatcttcaccgacgagaacaagtggaagtccgcccgcgaggcggtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggtcccgggccatctggtacatgtggctgggcgcccgcttcctcgagttcgaggcgctggggttcctgaacgaggaccactggttcagccggggcaacagcctctccggggtggagggcgagggcctgcaccgcctggggtacatcctccgggacgtcggcaagaaggagggcggcgccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagaacaaggtggtccgggtgcagcgccccaccccgcggggcaccgtgatggacatcatcagccgccgcgaccagcgggggtccggccaggtcgggacctacggcctgaacacgttcaccaacatggaggcccagctcatccgccagatggagggcgaggggatcttcaagagcatccagcacctgaccgccaccgaggagatcgccgtgcagaactggctggcccgggtgggccgcgagcggctctcccgcatggcgatcagcggggacgactgcgtcgtgaagcccatcgacgaccggttcgcctccgccctgacggccctgaacgacatgggcaaggtgcgcaaggacatccagcagtgggagcccagccgggggtggaacgactggacccaggtccccttctgctcccaccacttccacgagctcgtgatgaaggacggccgcgtgctggtcgtgccgtgccggaaccaggacgagctgatcggccgcgcccggatcagccagggggcgggctggtccctcaaggagaccgcctgcctgggcaagagctacgcccagatgtggaccctgatgtacttccaccgccgggacctccgcctggccgccaacgcgatctgctccgccgtgcccagccactgggtccccacctcccggacgacctggagcatccacgccaagcacgagtggatgaccaccgaggacatgctggccgtgtggaaccgcgtgtggatccaggagaacccctggatggaggacaagacgccggtcgagtcctgggaggaggtgccctacctcggcaagcgggaggaccagtggtgcgggagcctgatcggcctgaccagccgcgcgacctgggccaagaacatccagaccgccatcaaccaggtgcgctccctcatcggcaacgaggagtacacggactacatgcccagcatgaagcggttccgccgggaggaggaggaggccggggtcctgtggtga

SEQ ID NO: 9775 - RNA, 9876 nt, synthetic construct
  misc_feature 1..9876: note = derived and/or modified CDS sequence (opt1) from DENV-2__JN368476__SS-prME
  source 1..9876: mol_type = other RNA
agcgccggcatgatcatcatgctgatccccaccgtgatggccttccacctcaccacccgcaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagtccaaggcctggctcgtgcaccgccagtggttcctggacctgcccctcccctggctgccgggggccgacaagcagggcagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccggccacctgaagtgccggctgcgcatggacaagctccagctgaaggggatgtcctacagcatgtgcacgggcaagttcaaggtggtgaaggagatcgccgagacccagcacgggaccatcgtcatccgggtgcagtacgagggcgacggctccccctgcaagatccccttcgagatcatggacctggagaagcgctacgtgctcgggcggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggcgccaagcgcatggccatcctgggggacaccgcctgggacttcggcagcctcggcggggtgttcacgtccatcgggaaggccctccaccaggtgttcggggcgatctacggcgccgccttcagcggggtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcggcagcgggatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctggggcaaggcgaagatgctctccaccgagagccacaaccagaccttcctgatcgacgggcccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggcgtgctggagagcgagatgatcatccccaagaacctcgcggggcccgtctcccagcacaactaccgcccgggctaccacacccagaccgccgggccctggcacctgggcaagctggagatggacttcgacttctgcgacgggaccacggtgatcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggcgtcctggggatggccctgttcctggaggagatgctgcggacgcgcgtgggcaccaagcacgccatcctcctggtggccgtcagcttcgtgaccctgatcaccgggaacatgtccttcaaggacctcggccgggtggtcgtgatggtggggacgaccatgaccgacgacatcggcatgggcgtcacctacctggccctgctcgccgcgttcaaggtgcgccccacgttcgccgccgggctgctgctccggaagctgaccagcaaggagctgatgatgaccaccatcggcatcgtgctcctgtcccagagcacgatccccgagaccatcctggagctcaccgacgccctggccctggggatgatggtcctcaagatcgtgcgcgacatggagaagtaccagctggcggtgaccatcatggccatcctgtgcgtcccgaacgccgtgatcctccagaacgcctggaaggtctcctgcacgatcctggccgtggtgagcgtcagccccctgctcctgaccagctcccagcagaagaccgactggatccccctggcgctcaccatcaagggcctgaaccccacggccatcttcctgaccaccctcagccgcaccaacaagaagcggtcctggccgctgaacgaggccatcatggccgtgggcatggtgagcatcctggcgtccagcctcctgaagaacgacatccccatgacggggcccctggtcgccggcgggctcctgaccgtgtgctacgtgctgaccggccgctccgccgacctcgagctggagcgggccaccgacgtcaagtgggaggaccaggccgagatcagcgggagctcccccatcctgagcatcacgatctccgaggacggcagcatgtccatcaagaacgaggaggaggagcagaccctcaccatcctgatccgcaccggcctgctcgtgatcagcgggctgttcccggtgtccatccccatcaccgcggccgcctggtacctgtgggaggtcaagaagcagcgggccggcgtgctctgggacgtgccctccccgccgcccatggggaaggccgagctggaggacggcgcgtaccgcatcaagcagaaggggatcctgggctactcccagatcggcgccggggtctacaaggagggcacgttccacaccatgtggcacgtgacccgcggggcggtgctcatgcacaagggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcctgttcaagacgaacaccgggaccatcggcgccgtgagcctcgacttctcccccggcaccagcgggtcccccatcatcgacaagaagggcaaggtggtcgggctgtacggcaacggcgtggtgacgcgcagcggggcctacgtctccgccatcgcccagaccgagaagtccatcgaggacaaccccgagatcgaggacgacatcttccggaagcgccggctgaccatcatggacctgcaccccggcgcggggaagaccaagcgctacctccccgccatcgtgcgggaggccatcaagcgcggcctgcggacgctgatcctcgccccgacccgcgtggtcgcggccgagatggaggaggccctgcgggggctgcccatccgctaccagacccccgccatccgggccgagcacaccggccgcgagatcgtggacctcatgtgccacgcgacgttcaccatgcgcctgctgtcccccgtgcgggtcccgaactacaacctcatcatcatggacgaggcccacttcaccgaccccgccagcatcgccgcccgcggctacatcagcacccgggtggagatgggggaggcggccggcatcttcatgacggccacgccgcccgggtcccgcgacccgttcccccagagcaacgcccccatcatcgacgaggagcgggagatccccgagcgctcctggaacaccggccacgagtgggtgaccgacttcaaggggaagacggtctggttcgtgccgagcatcaaggccggcaacgacatcgcggcctgcctgcggaagaacggcaagaaggtgatccagctgtcccgcaagaccttcgacagcgagtacgtcaagacccggaccaacgactgggacttcgtggtgacgaccgacatctccgagatgggggccaacttcaaggccgagcgcgtcatcgacccccggcgctgcatgaagcccgtgatcctcaccgacggcgaggagcgggtgatcctggcggggcccatgccggtcacccacagctccgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgcgagaaggtggacgcgatcgacggggagtaccggctgcgcggcgaggcccgcaagaccttcgtggacctcatgcggcgcggggacctgcccgtctggctggcctacaaggtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctactccgaccccctcgccctgaaggagttcaaggagttcgccgccggccgcaagagcctgaccctcaacctgatcacggagatggggcggctgcccaccttcatgacccagaagacccgcgacgcgctcgacaacctggccgtgctgcacacggccgaggccggcgggcgggcgtacaaccacgccctctccgagctgcccgagaccctggagaccctcctgctgctcaccctgctggccaccgtcacgggcggcatcttcctcttcctgatgagcgggcgcggcatcgggaagatgaccctgggcatgtgctgcatcatcaccgcctccgtgctcctgtggtacgcccagatccagccgcactggatcgcggccagcatcatcctggagttcttcctcatcgtgctgctgatccccgagcccgagaagcagcggacgccccaggacaaccagctcacgtacgtcgtgatcgccatcctgaccgtggtcgccgccaccatggcgaacgagatggggttcctggagaagaccaagaaggacctcggcctgggctccatcgccacgcagcagccggagagcaacatcctggacatcgacctccgccccgcctccgcctggaccctgtacgccgtggcgaccaccttcgtgacgcccatgctgcggcacagcatcgagaacagctccgtcaacgtgagcctcaccgccatcgccaaccaggccaccgtgctgatggggctgggcaaggggtggcccctctccaagatggacatcggcgtcccgctgctggccatcgggtgctacagccaggtgaaccccatcaccctcacggcggccctgctgctcctggtggcccactacgccatcatcggccccggcctgcaggcgaaggccacccgcgaggcccagaagcgggccgccgcggggatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacgggccccatctccaccctctgggaggggaacccgggccggttctggaacaccaccatcgccgtgagcatggcgaacatcttccgcggctcctacctggccggggccggcctcctcttcagcatcatgaagaacacgaccaacacccggcgcgggaccggcaacatcggcgagacgctgggggagaagtggaagtcccgcctgaacgccctcggcaagagcgagttccagacctacaagaagtccgggatccaggaggtcgaccggaccctggccaaggagggcatcaagcgcggggagaccgaccaccacgcggtgagccggggctccgccaagctgcgctggttcgtggagcggaacatggtcacgcccgagggcaaggtggtggacctcgggtgcggccgcgggggctggagctactactgcgggggcctgaagaacgtccgggaggtgaagggcctgaccaagggcgggcccgggcacgaggagcccatcccgatgtccacctacggctggaacctcgtgcgcctgcagagcggggtcgacgtgttcttcatcccgcccgagaagtgcgacaccctgctctgcgacatcggcgagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggccctgcagcggaagtacgggggcgcgctcgtgcgcaacccgctgagccggaacagcacccacgagatgtactgggtgtccaacgccagcgggaacatcgtctccagcgtgaacatgatctcccgcatgctgatcaaccggttcaccatgcgccacaagaaggccacgtacgagcccgacgtggacctcggcagcgggacccggaacatcggcatcgagtccgagatccccaacctggacatcatcggcaagcgcatcgagaagatcaaggaggagcacgagaccagctggcactacgaccaggaccacccctacaagacctgggcctaccacgggtcctacgagacgaagcagaccggcagcgcctccagcatggtcaacggggtggtgcggctgctcaccaagccgtgggacgtcctgcccaccgtgacgcagatggcgatgaccgacaccacccccttcggccagcagcgcgtgttcaaggagaaggtcgacacgcgcacccaggagcccaaggagggcaccaagaagctgatgaagatcaccgccgagtggctctggaaggagctggggaagaagaagacgccgcggatgtgcacccgcgaggagttcacccggaaggtgcgctccaacgccgccctgggcgccatcttcaccgacgagaacaagtggaagtccgcgcgggaggccgtggaggactcccgcttctgggagctcgtcgacaaggagcggaacctgcacctggaggggaagtgcgagacgtgcgtgtacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtcgagggcgaggggctccacaagctgggctacatcctgcgcgacgtgagcaagaaggagggcggggccatgtacgccgacgacaccgccggctgggacacccggatcaccctcgaggacctgaagaacgaggagatggtgacgaaccacatggagggggagcacaagaagctggcggaggccatcttcaagctcacctaccagaacaaggtcgtgcgcgtgcagcggcccacgccccggggcaccgtcatggacatcatcagccggcgcgaccagcgggggtccggccaggtgggcacgtacgggctgaacaccttcaccaacatggaggcccagctgatccgccagatggagggcgagggggtgttcaagaacatccagcacctcaccgtcacggaggaggccgccgtgcagaactggctggcgcgggtgggccgcgagcgcctgagccggatggccatctccggcgacgactgcgtcgtgaagcccctcgacgaccgcttcgccaacgccctgaccgccctgaacgacatggggaagatccggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgacggtgtggaaccgggtctggatccgcgagaacccctggatggaggacaagacccccgtggagagctgggaggagatcccctacctcgggaagcgggaggaccagtggtgcggctccctgatcgggctgaccagccgcgccacctgggcgaagaacatccaggccgccatcaaccaggtgcggtccctcatcggcaacgaggagtacacggactacatgccgagcatgaagcgcttccggcgcgaggaggaggaggccggggtcctgtggtga

SEQ ID NO: 9776 - RNA, 9876 nt, synthetic construct
  misc_feature 1..9876: note = derived and/or modified CDS sequence (opt1) from DENV-2__JF260983__SS-prME
  source 1..9876: mol_type = other RNA
accgccgggttcctgatcatggtgatccccaccgtcatggccttccacctcaccacccggaacggggagccccacatgatcgtgagcaagaacgagaagggcaaggggctgctgttcaagaccgagaacggcatcaacatgtgcaccctcatggcgatggacctgggggagctgtgcgaggacacggtgacctacaagtgccccttcctcaagcagaacgagcccgaggacatcgactgctggtgcaactccaccagcacctgggtcacgtacgggacctgctccagcaccggcgagcaccggcgggagaagcggtccgtggccctggtgccccacgtcgggatgggcctggagacccggacggagacctggatgagctccgagggggcctggaagcaggcccagcggatcgagacctggatcctccgccaccccggcttcaccctgatggccgcggtgctggcctacacgatcgggaccacccacttccagcgggccctcatcttcatcctgctgaccgccgtggcgcccagcatgacgatgcgctgcatcggcatctccaaccgggacttcgtcgagggcgtgagcgggggctcctgggtggacatcgtcctcgagcacgggagctgcgtgaccaccatggccaagaacaagcccaccctggacttcgagctgatcaagacggaggccaagcagcccgccaccctccgcaagttctgcatcgaggccaagctgaccaacaccacgaccgagtcccggtgcccgacccagggcgagcccagcctggtggaggagcaggacaagcgcttcgtctgccggcactccatggtggaccgcggctgggggaacggctgcggcctcttcggcaagggcgggatcgtgacctgcgcgatgttcacgtgcctgaagaagatggagggcaaggtcgtgcagcccgagaacctggagtacaccatcgtgatcacgccccacagcggggaggagcacgccgtcggcaacgacaccgggaagcacggcaaggaggtgaagatcacgccgcagtccagcatctccgagaccgagctcaccgactacgggaccatcaccatggagtgcagcccccggacgggcctggacttcaacgagatggtgctgctccagatggagagcaaggcctggctggtccaccgccagtggttcctggacctccccctgccctggctgccgggcgccgacacccaggggtccaactggatccagaaggagatgctcgtgaccttcaagaacccccacgccaagcggcaggacgtcgtggtgctgggcagccaggagggggcgatgcacaccgccctgacgggcgccaccgagatccagatgtccctcgggaacatcctgttcatgggccacctgaagtgccgcctccggatggacaagctgcagctgaagggcatgagctactccatgtgcaccgggaagttcaaggtcgtgaaggagatcgccgagacccagcacggcacgatcgtgatccgcgtccagtacgagggggacgacagcccctgcaagatccccttcgagatcatggacctcgagaagaagcacgtgctgggccggctgatcaccgtgaacccgatcgtcaccgagaaggactcccccatcaacatcgaggccgagccgcccttcggcgacagctacatcgtgatcggggtggagccgggccagctcaagctgaactggttcaagaaggggtccagcatcggccagatgttcgagaccacgatgcgcggggcgaagcgcatggccatcctgggcgacaccgcctgggacttcggctccatcgggggcgtcttcaccagcgtggggaaggccctccaccaggtgttcggcgccatctacggggcggccttctccggcgtcagctggaccatgaagatcctgatcggcgtggtgatcacgtggatcgggatgaactcccggagcacctccctgagcgtcaccctggtgctcgtgggcatcgtcaccctgtacctgggggtgatggtgcaggccgactccggctgcgtcgtgagctggaagaacaaggagctcaagtgcgggagcggcatcttcgtgacggacaacgtccacacctggaccgagcagtacaagttccagcccgactcccccagcaagctggcctccgcgatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgagatcaaggggatcatgcaggccggccgccggagcctgaagccgcagcccaccgagctgcgctactcctggaagacgtgggggaaggccaaggtcctcagcaccgagctgcagaaccagaccttcctgatcgacggccccgagaccacggagtgcccgaactccaaccgggcctggaacagcctcgaggtggaggactacggcttcgggatcttcaccaccaacatctggctgaagctgcgcgagaagcaggacatgatctgcgactccaagctcatgagcgcggccgtgaaggacgaccgggccgtccacgccgacatgggctactggatcgagtcccgcctgaacgacacctggaagatggagaaggccagcttcatcgaggtgaagtcctgctactggccccggagccacacgctgtggtccaacggggtgctcgagagcgagatgatcatccccaagaacctggcgggccccgtcagccagcacaactaccgcccgggctactacacccagaccgccgggccctggcacctgggcaagctcgagatggacttcgagttctgcgaggggaccaccgtggtggtcacggaggactgcggcaaccgggggccctccctgcgcaccaccaccgccagcggcaagctgatcacggagtggtgctgccggtcctgcaccctcccgcccctgcgctaccggggcgaggacgggtgctggtacggcatggagatccgccccctgaaggagcgggaggagaacctcgtgaacagcctggtgaccgccgggcacggccagatcgacaacttctccctggggatcctcggcatggccctgctgctcgaggagatgctgcgcacccgcgtcggcacgaagcacgcgctgctcctggtggccatcagcttcgtgaccctgatcaccgggaacatgtccttcaaggacctcggccgggtcatcatcatggtgggggccgccatgaccgacgagatgggcatgggggtgacgtacctggcgctgctcgccgccttccgcgtccggcccaccttcgccgtgggcctgctgctccgcaagctgaccagcaaggagctgctcatggccaccatcggcgtggtcctgctgtcccagagcaacatccccgggacggtgctcgagctgaccgacgcgatcgccctgggcatcatggtcctcaagatcatgcggtccatggagaagtaccagctggccgtgaccgtgatggccatgctgtgcatccccaacgtcatgatcctccagcacgcctggaaggtggggtgcaccatcctggcggccgtgagcgtcagccccctgctcctgacgagctcccagcagaagaccgactggatccccctggccctcaccatcaagggcctgaaccccaccgccatcttcctgacgaccctcagccgcccgtccaagatccggagctggcccctgaacgaggccatcatggcggtgggcatggtgtccatcctggccagcagcctcctgaagaacgacatccccatgaccgggcccctggtcgccggcgggctcctgaccgtgtgctacgtgctgacgggccgctccgccgacctcgagctggagaaggcggccgaggtcaagtgggaggaccaggccgagatcagcgggtccagcccgatcctgtccatcaccatcagcgaggacggctccatgagcatcaagaacgaggaggaggagcagaccctcaccatcctgatccggacgggcctgctcgtgatctccgggctgttccccgtgagcatccccatcaccgccgccgcgtggtacctgtgggagaccaagaagcagcgcgccggcgtcctctgggacgtgccctccccgccgcccatggggaaggccgagctggaggacggcgcctaccggatcaagcagcgcgggatcttcggctacagccagatcggcgccggggtgtacaaggagggcaccttccacacgatgtggcacgtcacccgcggggcggtgctggtgcacaagggcaagcgcctcgagccgtcctgggccgacgtcaagaaggacctgatcagctacgggggcggctggaagctggagggggagtggaaggacggcgaggaggtccaggtgctcgccctggagcccgggaagaacccccgggccgtccagaccaagcccggcctgttcaagaccaacaccgggacgatcggcgccgtgtccctggacttcagcccgggcacctccgggagccccatcatcgaccgcaagggcaaggtggtcgggctctacggcaacggcgtggtgacccggtccgggacctacgtcagcagcatcgcgcagacggagaagtccgtggaggacaaccccgagatcgaggacgacatcttccgcaagaagcggctgaccatcatggacctgcaccccggcgccgggaagaccaagcgctacctcccggccatcgtgcgggaggccatccgccgcggcctgcggaccctgatcctcgcccccacgcgcgtcgtggcggccgagatggaggaggccctgcgggggctgcccatccgctaccagacccccgccatcaaggcggagcacaccggccgggagatcgtggacctcatgtgccacgccaccttcacgatgcgcctgctgagcccgatccgggtccccaactacaacctcatcatcatggacgaggcccacttcaccgaccccgcctccatcgccgcgcgcggctacatcagcacccgggtggagatgggggaggccgccggcatcttcatgaccgccacgcccccggggtcccgcgaccccttcccccagagcaacgcccccatcatggacgaggagcgggagatcccggagcgctcctggaacagcggccacgagtggatcaccaacttcaaggggaagaccgtgtggttcgtcccctccatccgggcgggcaacgacatcgccgcctgcctgcgcaagaacggcaagcgggtgatccagctgagccgcaagaccttcgacacggagtacaccaagacccggaccaacgactgggacttcgtggtcacgaccgacatctccgagatgggggccaacttcaaggccgagcgcgtgatcgacccccggcgctgcatgaagcccgtgatcctcaccgacggcgaggagcgcgtcgtgctggcggggccgatgcccgtgacccacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacgccggagggcatcatccccagcatgttcgagcccgagcgggagaaggtcgacgccatcgacggggagtaccgcctgcggggcgaggcccgcaagaccttcgtggacctcatgaagcgcggggacctgccggtgtggctggcctacaaggtcgcctccgagggcatcaactacgcggaccgcaagtggtgcttcgacgggatccggaacaaccagatcctcgaggagaacatcgaggtggaggtctggaccaaggagggcgagcgcaagaagctgaagccccggtggctggacgcccgcacctacagcgaccccctcgccctgaaggagttcaaggagttcgccgccggccggaagtccctgacgctcagcctgatcaccgagatggggcgcctgcccaccttcatgacccagaagacgcgggacgcgctcgacaacctggccgtgctgcactccgccgagatgggcgggcgcgcctacaaccacgccctcagcgagctgccggagaccctggagaccctcctgctgctcggcctgctggcgaccgtgacgggcgggatcttcctcttcctgatgagcggccgcggggtgggcaagatgaccctggggatgtgctgcatcatcaccgcctccggcctcctgtggtacgcccagatccagccccactggatcgccgcgagcatcatcctggagttcttcctcatcgtgctgctgatccccgagcccgagaagcagcgcaccccgcaggacaaccagctcacctacgtggtcatcgccatcctgacgctggtggccgccaccatggccaacgagatgggcttcctcgagaagaccaagaaggacctggggctgggcgggttcaccatgcagcagcccgagatcaacatcctcgacatcgacctgcggcccgcgtccgcctggacgctgtacgccgtggccaccaccttcgtcacccccatgctccgccacagcatcgagaactccagcgtgaacgtgtccctgacggccatcgcgaaccaggccaccgtcctgatgggcctcgggaagggctggccgctgagcaagatggacatcggcgtgcccctgctcgccatcgggtgctactcccaggtgaaccccatcaccctgaccgccgccctgctcctgctggtcgcgcactacgccatcatcggccccgggctccaggccaaggccacgcgcgaggcccagaagcgggcggccgccggcatcatgaagaacccgaccgtggacgggatcaccgtgatcgacctggagcccatcccctacgaccccaagttcgagaagcagctgggccaggtcatgctcctggtgctgtgcgtgacccaggtcctcatgatgcgcacgacctgggccctgtgcgaggcgctgaccctcgccaccggcccgatcagcacgctgtgggaggggaaccccggcaagttctggaacaccaccatcgccgtgtccatggccaacatcttccgggggagctacctggccggcgcgggcctcctgttctccatcatgcgcaacaccacgagcgcccggcgcgggaccggcaccatcggggagaccctgggcgagaagtggaagtcccggctcaacgccctggggcgcagcgagttccagatctacaagaagtccggcatccaggaggtggaccggacgctggccaaggagggcatcaagcgcggggagaccgaccaccacgccgtcagccggggctccgcgaagctccgctggttcgtggagcggaacatggtggcccccgaggggaaggtcgtggacctgggctgcgggcgcggcggctggagctactactgcgggggcctgaagaacgtgcgggaggtcaaggggctcaccaagggcgggcccggccacgaggagccgatccccatgagcacctacggctggaacctggtgcgcctgcagtccggggtggacgtcttcttcacgccgcccgagcggtgcgacaccctcctgtgcgacatcggcgagagctccccgaaccccaccgtggaggccgggcgcaccctgcgggtgctgaacctcgtcgagaactggctgggcagcaacacgcagttctgcatcaaggtgctgaacccctacatgccgtccgtgatcgagcgcatggagaccctccagcgcaagttcgggggcgccctggtccggaaccccctgagccgcaactccacccacgagatgtactgggtgagcaacgcctccggcaacatcgtgagctccgtcaacatgatcagccggatgctcatcaaccgcttcaccatgcggcacaagaaggcgacctacgagcccgacgtggacctggggtccggcacgcgcaacatcgggatcgagtgcgagacccccaacatggacatcatcggcaagcggatcgagaagatcaagcaggagcacgaggccagctggcactacgaccaggaccacccgtacaagacctgggcctaccacggctcctacgagaccaagcagacggggagcgcctccagcatggtgaacggcgtcgtgcgcctgctcaccaagccctgggacgtgatccccatggtcacccagatggcgatgaccgacacgacccccttcgggcagcagcgggtgttcaaggagaaggtggacacccgcacccaggagccgaaggagggcacgaagaagctgatgcggatcaccgccgagtggctgtggggcgagctcggccgccggaagaagccccgcatctgcacccgggccgagttctgcaacaaggtccgctccaacgccgccctgggcgcggtgttcaccgacgagaacaagtggaagtccgcccgggaggccgtcgaggacgagcgcttctgggagctggtggagaaggagcggaacctccacctggacgggaagtgcgagacgtgcgtgtacaacatgatgggcaagcgcgagaagaagctgggggagttcggcaaggccaaggggagccgggccatctggtacatgtggctcggcgcgcgcttcctggagttcgaggccctgggcttcctcaacgaggaccactggttctcccgcgagaacagcctgtccggggtcgagggcgaggggctgcacaagctcggctacatcctgcgggacatcagccgcaaggccgggggcgccatgtacgccgacgacaccgcgggctgggacacccggatcacctccgaggacctgaagaacgaggagatgatcacggaccagatggaggggcgccacaagaagctcgccgaggccatcttccggctgacctaccagaacaaggtggtgcgcgtccagcggcccacgccccgcggcaccgtgatggacatcatcagccggcgcgaccagcgggggtccggccaggtgggcacctacgggctgaacaccttcaccaacatggaggcccagctcatccgccagatggagggcgaggggctgttcaagagcatcctgcacctcaccccgcaggaggagacggcggtccacgcctggctggtgcgggagggccgcgagcggctggcccgcatggccatctccggggacgactgcgtggtcaagcccctcgacgaccggttcgcccgcgcgctgaccgccctgaacgacatgggcaaggtgcggaaggacatccagcagtgggagcccagcaagggctggtccgactggacccaggtgcccttctgcagccaccacttccacgagctcatcatgaaggacgggcgcaagctggtcgtgccgtgccgcaaccaggacgagctgatcggccgggcccgcatctcccagggggccggctggagcctccgggagaccgcctgcctggggaagtcctacgcgcagatgtggagcctgatgtacttccaccgccgggacctccgcctggccgccaacgccatctgctccgccgtgcccagccactgggtccccacgagccggaccacctggtccatccacgcgagccacgagtggatgaccacggaggacatgctggccgtgtggaaccgcgtgtggatccaggacaacccctggatggaggacaagaccccggtcgagtcctgggaggacatcccctacctcggcaagcgggaggaccagtggtgcggcagcctgatcgggctgacctcccgcgccacctgggccaagaacatccagaccgccatcaaccaggtgcgggcgctcatcggcgaggaggagtacatggactacatgcccagcatgaagcgcttccggtccgaggaggaggagagcggggtgctgtggtga

SEQ ID NO: 9777 - RNA, 9876 nt, synthetic construct
  misc_feature 1..9876: note = derived and/or modified CDS sequence (opt1) from DENV-2__AF119661__SS-prME
  source 1..9876: mol_type = other RNA
accgtgggggtcatcatcatgctgatccccaccgccatggccttccacctcaccacccgcaacggggagccccacatgatcgtgggccggcaggagaaggggaagtccctgctgttcaagaccgaggacggcgtgaacatgtgcaccctcatggcgatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgcccagcggatcgagacctggatcctgcgccaccccggcttcatcatcatggccgcgatcctggcctacaccatcgggaccacccacttccagcgggccctcatcttcatcctgctgacggccgtggcgcccagcatgaccatgcgctgcatcggcgtgtccaaccgggacttcgtcgagggcgtgagcgggggctcctgggtggacatcgtcctcgagcacgggagctgcgtgaccaccatggccaagaacaagcccacgctggacttcgagctgatcaagaccgaggccaagcagcccgtgaccctccgcaagtactgcatcaaggccaagctgaccaacacgaccaccgagtcccggtgcccgacccagggcgagcccagcctgaacgaggagcaggacaagcgcttcgtctgcaagcactccatggtggaccggggctgggggaacggctgcgggctgttcggcaagggcgggatcgtgacgtgcgccaccttcacgtgcaagaagaacatggagggcaagatcgtccagcccgagaacctggagtacaccatcgtgatcacgccccacagcggggaggagcacgcggtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgccaagaagcaggacgtggtcgtgctcgggtcccaggagggcgcgatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggccgagccgcccttcggcgactcctacatcatcatcggggtcgagccgggccagctgaagctcaactgggtgaagaaggggagctccatcggccagatgttcgagaccacgatgcgcggcgcgaagcggatggccatcctgggggacaccgcctgggacttcggcagcctcggcggggtgttcacctccatcgggaaggccctccaccaggtcttcggggccatctacggcgcggccttcagcggggtgtcctggaccatgaagatcctgatcggcgtgatcatcacgtggatcgggatgaacagccgctccaccagcctgtccgtcagcctggtgctcgtgggcgtcatcaccctgtacctgggggccatggtgcaggccgactccggctgcgtggtcagctggaagaacaaggagctcaagtgcggctccgggatcttcatcaccgacaacgtgcacacgtggaccgagcagtacaagttccagcccgagagccccagcaagctggcgtccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccaccgagctgaagtactcctggaagacctggggcaaggccaagatgctcagcacggagtcccacaaccagaccttcctgatcgacgggcccgagaccgcggagtgcccgaacaccaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggccgtgcacgcggacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagtccttcgccgggcccgtgagccagcacaactaccgcccgggctactacacccagacggccgggccctggcacctcggcaagctggagatggacttcgacttctgcgaggggaccaccgtggtcgtgaccgaggactgcggcaaccggggccccagcctgcgcacgaccaccgcgtccgggaagctcatcaccgagtggtgctgccggagctgcacgctgcccccgctgcgctaccggggcgaggacgggtgctggtacggcatggagatccgccccctcaaggagaaggaggagtccctggtggacagcctggtcaccgccgggcacggccagatcgacaacttctccctcggcgtgctggggatggccctgttcctcgaggagatgctgcggacccgcgtgggcaccaagcacgccatcctgctcgtcgcggtgagcttcgtgacgctgatcaccgggaacatgtccctgcgggacctcggccgcgtcatggtgatggtgggggccaccatgaccgacgacatcggcatgggcgtcacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtgctcaagatcgtccgcaacatggagaagtaccagctggccgtgaccatcatggccatctcctgcgtgccgaacgccgtcatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctggcccggacctccaagaagcgcagctggccgctcaacgaggccatcatggccgtgggcatggtctccatcctggccagcagcctgctcaagaacgacatccccatgaccgggcccctggtggcgggcgggctgctcacggtgtgctacgtcctgaccggccggtccgccgacctggagctcgagcgcgccaccgacgtgaagtgggaggaccaggccgagatcagcgggtccagccccatcctgtccatcaccatcagcgaggacggctccatgagcatcaagaacgaggaggaggagcagacgctgaccatcctcatccggaccggcctgctggtgatctccggcctcttcccggtcagcatccccatcaccgccgcggcctggtacctgtgggaggtgaagaagcagcgcgccggcgtgctgtgggacgtccccagcccgccgcccgtggagaaggccgagctcgaggacggggcctaccggatcaagcagaagggcatcctggggtacagccagatcggcaccggcgtgtacaaggaggggacgttccacaccatgtggcacgtcacccgcggcgcggtgctgatgcaccgggggaagcgcatcgagccctcctgggccgacgtgaagaaggacctcatcagctacggcgggggctggaagctggagggcgagtggaaggagggggaggaggtccaggtgctggccctcgagcccggcaagaacccccgggccgtgcagaccaagcccgggctgttcaagacgaacaccggcaccatcggggccgtctccctggacttcagccccggcacctccggcagccccatcgtggaccgcaaggggaaggtggtcggcctctacgggaacggcgtggtgacgcggtccggcgcgtacgtcagcgccatcgcccagaccgagaagtccatcgaggacaaccccgagatcgaggacgacatcttccgcaagaagcggctgaccatcatggacctgcaccccggggccggcaagaccaagcgctacctgcccgcgatcgtgcgggaggccatcaagcgcgggctccggacgctgatcctggccccgacccgcgtggtcgccgccgagatggaggaggcgctccgcggcctgcccatccggtaccagacccccgccatccgcgccgagcacaccgggcgggagatcgtggacctgatgtgccacgccacgttcaccatgcgcctcctgtcccccgtgcgggtcccgaactacaacctgatcatcatggacgaggcccacttcaccgaccccgcgaacatcgccgcccgcggctacatcagcacccgggtggagatgggcgaggccgccgggatcttcatgacggcgacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgccgcgtgcctccggaagaacggcaagaaggtgatccagctgagccgcaagacgttcgactccgagtacgtcaagacccggaccaacgactgggacttcgtggtgaccacggacatcagcgagatgggcgccaacttcaaggccgagcgcgtcatcgacccccggcgctgcatgaagcccgtgatcctgaccgacggggaggagcgggtgatcctcgccggccccatgccggtcacccactccagcgccgcgcagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcccgcaagacgttcgtggacctgatgcggcgcggcgacctccccgtctggctggcgtaccgggtggccgccgaggggatcaactacgccgaccgccggtggtgcttcgacggcgtgaagaacaaccagatcctggaggagaacgtcgaggtggagatctggaccaaggagggggagcgcaagaagctcaagccgcggtggctggacgcccgcatctacagcgaccccctggcgctcaaggagttcaaggagttcgccgccggccggaagtccctgaccctgaacctcatcaccgagatgggccgcctgcccacgttcatgacccagaaggcccgggacgcgctggacaacctcgccgtcctgcacaccgccgaggccgggggccgcgcctacaaccacgcgctgagcgagctccccgagaccctggagacgctgctcctgctgaccctcctggccaccgtgaccgggggcatcttcctgttcctcatgtccggcaagggggtgggcaagatgaccctggggatgtgctgcatcatcacggccagcatcctgctctggtacgcccagatccagccgcactggatcgccgcgtccatcatcctggagttcttcctgatggtcctcctgatccccgagcccgagaagcagcggacgccccaggacaaccagctgacctacgtggtgatcgccatcctcaccgtcgtggccgccacgatggccaacgagatgggcttcctggagaagaccaagaaggacctggggctcggcagcatcgcgacccaggagccggagagcaacatcctggacatcgacctgcgccccgcctccgcctggaccctctacgccgtggccacgaccttcgtcacccccatgctgcggcacagcatcgagaactccagcgtgaacgtgtccctgaccgcgatcgccaaccaggccacggtcctcatgggcctggggaagggctggcccctgagcaagatggacatcggggtgccgctcctggccatcggctgctactcccaggtgaaccccatcaccctgaccgcggccctcctgctgctcgtcgcccactacgccatcatcgggcccggcctgcaggccaaggcgacccgcgaggcccagaagcgggccgccgccggcatcatgaagaaccccacggtggacgggatcaccgtgatcgacctggacccgatcccctacgaccccaagttcgagaagcagctcggccaggtcatgctgctgatcctctgcgtgacccaggtgctgatgatgcgcaccacgtgggcgctgtgcgaggccctcaccctggccaccgggcccatcagcaccctgtgggagggcaacccggggcgcttctggaacacgaccatcgccgtctccatggccaacatcttccggggcagctacctcgcgggcgccgggctgctgttcttcatcatgaagaacaccaccaacacgcgccggggcaccgggaacatcggcgagaccctcggcgagaagtggaagtcccgcctgaacgccctgggcaagagcgagttccagatctacaagaagtccggcatccaggaggtggaccggaccctcgccaaggaggggatcaagcgcggcgagacggaccaccacgcggtgagccgggggtccgccaagctgcgctggttcgtcgagcggaacatggtgacccccgagggcaaggtggtcgacctgggctgcgggcgcggcgggtggagctactactgcggcgggctcaagaacgtgcgggaggtgaagggcctgaccaagggcgggcccggccacgaggagcccatcccgatgtccacctacgggtggaacctggtccgcctccagagcggcgtggacgtgttcttcacgccgcccgagaagtgcgacaccctgctgtgcgacatcggggagtccagccccaacccgaccatcgaggccggccggaccctccgcgtcctgagcctggtggagaactggctcaacaacgacacccagttctgcatcaaggtgctgaacccctacatgccctccgtcatcgagaagatggagacgctgcagcggaagtacggcggggccctggtgcgcaacccgctcagccggaactccacccacgagatgtactgggtgagcaacgccaccggcaacatcgtctccagcgtgaacatgatctcccgcatgctgatcaaccggttcaccatgaagcacaagaaggcgacgtacgagcccgacgtggacctggggagcggcacccgcaacatcgggatcgagtccgagatccccaacctcgacatcatcggcaagcgcatcgagaagatcaagcaggagcacgagaccagctggcactacgaccaggaccacccctacaagacctgggcctaccacggctcctacgagacgaagcagaccgggagcgcctccagcatggtcaacggcgtggtgcggctgctgaccaagccgtgggacgtcgtgcccatggtgacccagatggccatgacggacaccacccccttcgggcagcagcgcgtcttcaaggagaaggtggacacccggacgcaggagcccaaggagggcaccaagaagctcatgaagatcaccgccgagtggctgtggaaggagctgggcaagaagaagaccccgcgcatgtgcacgcgggaggagttcacccgcaaggtgcggtccaacgcggccctcggggccatcttcaccgacgagaacaagtggaagtccgcccgcgaggccgtcgaggacaaccggttctgggagctggtggacaaggagcgcaacctgcacctcgagggcaagtgcgagacctgcgtctacaacatgatggggaagcgggagaagaagctgggcgagttcgggaaggcgaagggctcccgcgccatctggtacatgtggctgggcgcccggttcctcgagttcgaggccctggggttcctgaacgaggaccactggttcagccgcgagaactccctcagcggcgtggagggggagggcctgcacaagctggggtacatcctccgggacgtgagcaagaaggagggcggcgcgatgtacgccgacgacacggccgggtgggacacccgcatcaccctggaggacctgaagaacgaggagatggtcaccaaccacatggagggcgagcacaagaagctcgccgaggccatcttcaagctgacgtaccagaacaaggcggtgcgggtgcagcgccccacgccccgggggaccgtcatggacatcatctcccgccgggaccagcgcggcagcggccaggtgggcacctacggcctgaacacgttcaccaacatggaggcccagctcatccgccagatggagggggagggcatcttcaagtccatccagcacctgaccgtgaccgaggagatcgccgtccagaactggctggcccgggtggggcgcgagcggctcagccgcatggccatctccggcgacgactgcgtggtcaagcccctggacgaccggttcgcgagcgccctgacggccctcaacgacatgggcaaggtgcgcaaggacatccagcagtgggagccgtcccgggggtggaacgactggacccaggtgcccttctgcagccaccacttccacgagctgatcatgaaggacggccgcgtcctggtggtgccctgccggaaccaggacgagctcatcgggcgcgcccggatctcccagggcgccgggtggagcctgaaggagaccgcgtgcctgggcaagtcctacgcccagatgtggagcctcatgtacttccaccgccgggacctgcgcctggccgccaacgccatctgctccgcggtccccagccactgggtgccgacctcccggaccacgtggagcatccacgccaagcacgagtggatgaccaccgaggacatgctcaccgtgtggaaccgcgtctggatccaggagaacccctggatggaggacaagacgcccgtggagtcctgggaggaggtgccctacctgggcaagcgggaggaccagtggtgcgggagcctgatcggcctcaccagccgcgccacctgggccaagaacatccagaccgcgatcaaccaggtccggtccctgatcgggaacgaggagtacacggactacatgccgagcatgaagcgcttccgccgggaggaggaggaggccggcgtgctgtggtga

SEQ ID NO: 9778 - RNA, 9876 nt, synthetic construct
  misc_feature 1..9876: note = derived and/or modified CDS sequence (opt1) from DENV-2__EU056810__SS-prME
  source 1..9876: mol_type = other RNA
accgccggcatcatcatcatgctgatccccaccgtgatggccttccacctcaccacccggaacggggagccccacatgatcgtctcccggcaggagaagggcaagtccctgctgttcaagaccgaggacggggtgaacatgtgcaccctcatggcgatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccggcgggagaagcggagcgtcgccctggtgccccacgtgggcatggggctcgagacgcgcaccgagacctggatgtccagcgagggcgcctggaagcacgcccagcggatcgagacctggatcctgcggcaccccgggttcacgatcatggcggccatcctggcctacaccatcggcaccacctacttccagcgggtcctcatcttcatcctgctgacggccgtggcgccctccatgaccatgcgctgcatcgggatcagcaaccgggacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccgcaagtactgcatcgaggccaagctgaccaacacgaccaccgcgagccggtgcccgacccagggggagccctccctgaacgaggagcaggacaagcgcttcgtgtgcaagcacagcatggtggaccggggctggggcaacgggtgcggcctcttcgggaagggcgggatcgtcacgtgcgccatgttcacgtgcaagaagaacatggagggcaaggtggtgcagcccgagaacctggagtacaccatcgtcatcacgccccactccggcgaggagaacgccgtggggaacgacacgggcaagcacgggaaggagatcaagatcaccccgcagagctccatcaccgaggccgagctgaccggctacgggaccgtgacgatggagtgcagcccccgcaccggcctcgacttcaacgagatggtcctgctgcagatggagaacaaggcctggctcgtgcaccggcagtggttcctggacctgcccctcccctggctgccgggcgcggacacccaggggtccaactggatccagaaggagaccctggtgacgttcaagaacccccacgccaagaagcaggacgtcgtggtcctcggcagccaggagggggccatgcacaccgccctgaccggcgccaccgagatccagatgagctccgggaacctcctgttcacgggccacctgaagtgccgcctgcggatggacaagctccagctgaagggcatgagctactccatgtgcaccgggaagttcaaggtggtgaaggagatcgcggagacccagcacggcaccatcgtcgtgcgcgtgcagtacgagggggacggcagcccctgcaagatccccttcgagatcatggacctggagaagcggcacgtcctcggccgcctgatcacggtgaacccgatcgtgaccgagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgccaagcggatggccatcctgggcgacacggcctgggacttcgggtccctgggcggggtgttcaccagcatcggcaaggcgctccaccaggtcttcggggccatctacggcgccgccttctccggcgtgagctggaccatgaagatcctgatcggggtggtcatcacctggatcggcatgaactcccgcagcacgtccctgagcgtgtccctggtgctcgtcggggtggtgaccctgtacctgggcgtcatggtgcaggcggacagcgggtgcgtggtctcctggaagaacaaggagctcaagtgcggcagcggcatcttcgtgaccgacaacgtgcacacctggacggagcagtacaagttccagcccgagagcccctccaagctggccagcgccatccagaaggcccacgaggaggggatctgcggcatccggtccgtcacccgcctggagaacctcatgtggaagcagatcacccccgagctgaaccacatcctgagcgagaacgaggtgaagctcaccatcatgacgggggacatcaagggcatcatgcaggccgggaagcggtccctgcgcccgcagcccaccgagctgaagtacagctggaagacctggggcaaggcgaagatgctctccaccgagctgcacaaccagacgttcctgatcgacggccccgagaccgccgagtgcccgaacaccaaccgggcctggaacagcctcgaggtggaggactacgggttcggcgtcttcaccacgaacatctggctgaagctgaaggagcgccaggacgtgttctgcgactccaagctcatgagcgccgccatcaaggacaaccgggcggtgcacgccgacatggggtactggatcgagtccgccctgaacgacacctggaagatcgagaaggccagcttcatcgaggtcaagtcctgccactggcccaagagccacaccctgtggtccaacggcgtgctcgagagcgagatgatcatccccaagaacttcgccggccccgtgtcccagcacaactaccgcccggggtaccacacccagaccgcgggcccctggcacctggggaagctggaggtcgacttcaacttctgcgagggcacgaccgtggtggtcaccggggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtgacggccgggcacggccagatcgacaacttctccctgggcgtcctggggatggccctcttcctggaggagatgctgcggacccgcgtgggcaccaagcacgcgatcctcctggtggccgtcagcttcgtgaccctgatcacggggaacatgtccttccgggacctcggccgcgtgatggtcatggtgggggccaccatgaccgacgacatcggcatgggcgtgacctacctggccctgctcgccgcgttcaaggtccgccccacgttcgccgccgggctgctgctccggaagctgaccagcaaggagctgatgatgaccaccatcggcatcgtgctcctgtcccagagcacgatccccgagaccgtcctggagctcaccgacgccctggccctggggatgatggtgctcaagatcgtgcgcaacatggagaagtaccagctggcggtcaccatcatggccatcctgtgcgtgccgaacgccgtgatcctccagaacgcctggaaggtctcctgcacgatcctggccgtggtgagcgtcagccccctgctcctgaccagctcccagcagaaggcggactggatccccctggccctcaccatcaagggcctgaaccccaccgccatcttcctgacgaccctcagccggacctccaagaagcgcagctggccgctgaacgaggccatcatggcggtgggcatggtgtccatcctggccagctccctcctgaagaacgacatccccatgaccgggcccctggtcgccggcgggctcctgacggtgtgctacgtgctgaccggccggagcgccgacctcgagctggagcgcgccgcggacgtccggtgggaggaccaggccgagatcagcgggtccagccccatcctgtccatcaccatcagcgaggacggctccatgagcatcaagaacgaggaggaggagcagaccctcacgatcctgatccgcaccggcctgctcgtgatctccgggctgttcccggtgagcatccccatcaccgccgccgcctggtacctgtgggaggtcaagaagcagcgggcgggcgtgctctgggacgtgcccagcccgccgcccgtcgggaaggccgagctggaggacggcgcctaccgcatcaagcagaaggggatcctgggctacagccagatcggcgccggggtgtacaaggagggcaccttccacaccatgtggcacgtgacgcgcggggccgtcctcatgcacaagggcaagcgcatcgagccctcctgggcggacgtgaagaaggacctgatcagctacgggggcggctggaagctggagggggagtggaaggagggcgaggaggtgcaggtcctcgccctggagcccgggaagaacccccgggccgtgcagaccaagcccggcctgttcaagaccaacaccgggacgatcggcgccgtgtccctcgacttcagccccggcacctccgggagccccatcgtcgacaagaagggcaaggtggtggggctgtacggcaacggcgtcgtgacccgctccgggacctacgtgagcgccatcgcgcagacggagaagtccatcgaggacaaccccgagatcgaggacgacatcttccggaagaagcgcctgaccatcatggacctgcaccccggcgccgggaagaccaagcggtacctccccgccatcgtccgcgaggccatcaagcggggcctgcgcaccctgatcctcgcgccgacgcgggtggtggccgccgagatggaggaggccctgcgcgggctgcccatccgctaccagacccccgccatccgggcggagcacaccggccgcgagatcgtcgacctcatgtgccacgccaccttcacgatgcggctgctgagccccgtgcgcgtgccgaactacaacctcatcatcatggacgaggcccacttcaccgaccccgccagcatcgccgcgcggggctacatctccacccgcgtcgagatgggggaggccgccggcatcttcatgaccgccacgccgcccgggagccgggacccgttcccccagtccaacgcccccatcatggacgaggagcgcgagatccccgagcggagctggaactccggccacgagtgggtgaccgacttcaaggggaagaccgtgtggttcgtcccgagcatcaaggcgggcaacgacatcgccgcctgcctgcgcaagaacggcaagaaggtgatccagctgtcccggaagaccttcgacagcgagtacatcaagacgcgcaccaacgactgggacttcgtggtcaccaccgacatctccgagatgggggccaacttcaaggcggagcgggtgatcgacccccgccggtgcatgaagcccgtgatcctcacggacggcgaggagcgcgtcatcctggccgggcccatgccggtgacccacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgcgagaaggtcgacgccatcgacggggagtaccggctgcgcggcgaggcccggaagaccttcgtggacctcatgcgccgcggggacctgcccgtgtggctggcctaccgcgtcgccgcggagggcatcaactacgccgaccggcgctggtgcttcgacgggatcaagaacaaccagatcctcgaggagaacgtggaggtggagatctggacgaaggagggcgagcggaagaagctgaagccgcgctggctggacgcccggatctactccgaccccctcgccctgaaggagttcaaggagttcgccgcgggccgcaagagcctgaccctcaacctgatcaccgagatggggcggctgcccaccttcatgacgcagaaggcccgcaacgccctcgacaacctggccgtcctgcacaccgcggaggccggcgggcgggcctacaaccacgccctctccgagctgcccgagaccctggagaccctcctgctgctcacgctgctggccaccgtgaccggcggcatcttcctcttcctgatgagcgggaagggcatcgggaagatgaccctgggcatgtgctgcatcatcaccgcgtccatcctcctgtggtacgcccagatccagccgcactggatcgccgccagcatcatcctggagttcttcctcatcgtgctgctgatccccgagcccgagaagcagcgcacgccccaggacaaccagctcacctacgtcgtgatcgccatcctgaccgtggtcgcggccaccatggccaacgagatggggttcctggagaagacgaagaaggacttcggcctcggctccatcgccacccagcagccggagagcaacatcctggacatcgacctgcggcccgccagcgcgtggaccctctacgccgtggccaccacgttcatcacccccatgctgcgccactccatcgagaacagctccgtgaacgtcagcctgaccgccatcgccaaccaggcgaccgtgctcatggggctgggcaaggggtggcccctgtccaagatggacatcggcgtgccgctcctggccatcgggtgctacagccaggtcaaccccatcacgctgaccgccgccctcctgctgctcgtggcgcactacgccatcatcggccccggcctgcaggccaaggccacccgggaggcccagaagcgcgcggccgccgggatcatgaagaaccccaccgtggacggcatcacggtcatcgacctggacccgatcccctacgaccccaagttcgagaagcagctcggccaggtgatgctgctggtgctctgcgtcacccaggtgctgatgatgcggaccacctgggccctgtgcgaggccctcacgctggcgaccggccccatctccaccctgtgggaggggaacccgggccgcttctggaacaccacgatcgccgtgagcatggccaacatcttccgcggctcctacctcgccggggccggcctgctgttcagcatcatgaagaacaccgcgaacacccggcgcgggaccggcaacacgggcgagaccctcggggagaagtggaagaaccggctgaacgccctgggcaagtccgagttccagatctacaagaagtccgggatccaggaggtcgaccgcaccctcgccaaggagggcatcaagcgcggggagaccgaccaccacgccgtgtcccgcggcagcgcgaagctgcggtggttcgtggagcgcaacctggtcacgcccgagggcaaggtggtggacctcgggtgcggccgcggcgggtggtcctactactgcggcgggctgaagaacgtccgcgaggtgaaggggctgaccaagggcgggcccgggcacgaggagcccatcccgatgagcacctacggctggaacctcgtgcggctgcagtccggggtcgacgtgttcttcacgccgcccgagaagtgcgacacgctgctctgcgacatcggcgagagctcccccaacccgaccatcgaggccggccgcaccctgcgggtgctgaacctcgtcgagaactggctgaacaacaacacccagttctgcatcaaggtgctgaacccctacatgcccagcgtgatcgagaagatggaggccctgcagcgcaagtacgggggcgccctcgtccggaacccgctgagccgcaactccacccacgagatgtactgggtgagcaacgcctccgggaacatcgtgagctccgtcaacatgatcagccggatgctgatcaaccgcttcacgatgcggcacaagaaggcgacctacgagcccgacgtggacctcggctccgggacccgcaacatcggcatcgagagcgagacccccaacctggacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtcgtgcggctgctcacgaagccgtgggacgtgatccccaccgtcacccagatggccatgaccgacacgacccccttcggccagcagcgcgtgttcaaggagaaggtcgacacccggacccaggagcccaaggagggcacgaagaagctgatgaagatcaccgccgagtggctgtggaaggagctcgggaagaagaagaccccgcgcatgtgcacccgggaggagttcacgcgcaaggtgcggagcaacgcggccctgggcgccatcttcaccgacgagaacaagtggaagtccgcccgcgaggccgtggaggacagccggttctgggagctggtcgacaaggagcgcaacctccacctggaggggaagtgcgagacctgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgagaactccctgagcggggtggagggcgaggggctgcacaagctcggctacatcctgcgggacgtcagcaagaaggagggcggggcgatgtacgccgacgacaccgccggctgggacacgcgcatcaccctggaggacctcaagaacgaggagatggtgaccaaccacatggagggggagcacaagaagctggccgaggccatcttcaagctgacctaccagaacaaggtggtccgggtgcagcgccccacgccccggggcaccgtgatggacatcatctcccgccgggaccagcgcgggagcggccaggtcggcacctacgggctcaacaccttcacgaacatggaggcgcagctgatccgccagatggagggcgagggggtgttcaagtccatccagcacctgaccgtgaccgaggagatcaccgtcaagaactggctcgcccgggtgggccgcgagcggctgagccgcatggccatctccggcgacgactgcgtggtcaagcccctggacgaccggttcgccagcgccctcacggcgctgaacgacatggggaaggtgcgcaaggacatccagcagtgggagccgtcccggggctggaacgactggacccaggtgcccttctgcagccaccacttccacgagctgatcatgaaggacgggcgcgtcctcgtggtgccctgccggaaccaggacgagctgatcggccgcgcccggatctcccagggggccggctggagcctgcgcgagaccgcctgcctcggcaagtcctacgcccagatgtggagcctgatgtacttccaccggcgcgacctgcggctcgcggccaacgccatctgctccgccgtccccagccactgggtgccgacctcccgcaccacgtggagcatccacgcccggcacgagtggatgaccaccgaggacatgctgaccgtgtggaaccgcgtctggatccaggagaacccctggatggaggacaagacgcccgtggagtcctgggaggagatcccctacctggggaagcgggaggaccagtggtgcggcagcctcatcgggctgaccagccgcgcgacctgggccaagaacatccagaccgccatcaaccaggtgcgctccctgatcggcaacgaggagtacacggactacatgccgagcatgaagcggttccgccgggaggaggaggaggccggggtcctctggtga

SEQ ID NO: 9779 - RNA, 9876 nt, synthetic construct
  misc_feature 1..9876: note = derived and/or modified CDS sequence (opt1) from DENV-2__EU056811__SS-prME
  source 1..9876: mol_type = other RNA
accgcgggcatgatcatcatgctgatccccaccgtgatggccttccacctcaccacccgcaacggggagccccacatgatcgtcagccggcaggagaagggcaagagcctgctgttcaagaccaaggacgggaccaacatgtgcaccctcatggcgatggacctgggcgagctgtgcgaggacaccatcacctacaagtgccccttcctcaagcagaacgagcccgaggacatcgactgctggtgcaacagcaccagcacctgggtgacctacgggacctgcaccacgaccggcgagcaccgccgggagaagcgcagcgtggccctggtcccccacgtgggcatggggctggagacccggaccgagacgtggatgtccagcgagggcgcctggaagcacgcccagcgcatcgagacctggatcctccggcaccccgggttcaccatcatggccgcgatcctggcctacaccatcggcacgacccacttccagcgcgtgctgatcttcatcctcctgaccgccatcgccccctccatgaccatgcggtgcatcgggatcagcaaccgcgacttcgtcgagggcgtgtccggcgggagctgggtggacatcgtcctggagcacggctcctgcgtgacgaccatggcgaagaacaagcccaccctcgacttcgagctgatcaagaccgaggccaagcagcccgccacgctgcggaagtactgcatcgaggccaagctcaccaacaccaccacggacagccgctgcccgacccagggggagcccaccctgaacgaggagcaggacaagcggttcgtgtgcaagcactccatggtcgaccgcggctggggcaacgggtgcggcctgttcgggaagggcgggatcgtgacctgcgccatgttcacgtgcaagaagaacatggagggcaagatcgtgcagcccgagaacctcgagtacaccgtcgtgatcacgccccacagcggcgaggagcacgcggtggggaacgacaccggcaagcacgggaaggaggtcaagatcaccccgcagtccagcatcacggaggccgagctgaccggctacgggaccgtgaccatggagtgcagcccccggacgggcctggacttcaacgagatggtgctcctgcagatggaggacaaggcctggctggtccaccgccagtggttcctcgacctgcccctgccctggctcccgggcgccgacacccaggggagcaactggatccagaaggagaccctggtgaccttcaagaacccccacgccaagaagcaggacgtggtcgtgctgggctcccaggagggggcgatgcacacggccctcaccggcgccaccgagatccagatgagcagcgggaacctgctgttcaccggccacctcaagtgccggctgcgcatggacaagctgcagctcaagggcatgtcctacagcatgtgcacggggaagttcaagatcgtcaaggagatcgccgagacccagcacggcaccatcgtgatccgggtgcagtacgagggggacggctccccctgcaagatccccttcgagatcatggacctggagaagcgccacgtcctgggccggctcatcaccgtgaacccgatcgtgacggagaaggacagccccgtcaacatcgaggccgagccgcccttcggggactcctacatcatcatcggcgtggagccggggcagctgaagctggactggttcaagaagggcagctccatcgggcagatgttcgagaccaccatgcgcggcgcgaagcgcatggccatcctcggcgacaccgcctgggacttcgggagcctgggcggggtgttcacgtccatcggcaaggccctgcaccaggtcttcggggccatctacggcgcggccttcagcggcgtgtcctggaccatgaagatcctcatcggggtgatcatcacctggatcggcatgaacagccggtccaccagcctgtccgtcagcctggtgctggtggggatcgtcacgctctacctgggcgtgatggtgcaggccgactccgggtgcgtcgtgagctggaagaacaaggagctgaagtgcggctccggcatcttcgtgaccgacaacgtccacacctggaccgagcagtacaagttccagcccgagagccccagcaagctcgcctccgcgatccagaaggcccacgaggaggggatctgcggcatccgcagcgtgacgcggctggagaacctgatgtggaagcagatcacctccgagctcaaccacatcctgagcgagaacgaggtgaagctgaccatcatgaccggggacatcaagggcatcatgcaggtcgggaagcgctccctccggccccagccgacggagctgcgctacagctggaagacctggggcaaggccaagatgctgtccaccgagctccacaaccagaccttcctgatcgacggccccgagacggccgagtgccccaacaccaaccgggcctggaacagcctggaggtggaggactacgggttcggcgtgttcaccaccaacatctggctccgcctgcgggagaagcaggacgcgttctgcgactccaagctgatgagcgccgccatcaaggacaaccgcgccgtccacgccgacatggggtactggatcgagtccgcgctcaacgacacctggaagatcgagaaggccagcttcatcgaggtgaagtcctgccactggcccaagtcccacacgctgtggtccaacggcgtgctggagagcgagatggtcatccccaagaacatcgccggccccgtgtcccagcacaacaaccggcccgggtaccacacccagaccgccggcccgtggcacctcgggaagctggagatggacttcgacttctgcgagggcaccacggtggtcgtgaccgaggagtgcgggaaccgcggccccagcctgcggaccaccacggccagcggcaagctcatcaccgagtggtgctgccgctcctgcaccctgccgcccctgcggtaccgcggggaggacggctgctggtacgggatggagatccggccgctcaaggagaaggaggagaacctggtgagctccctggtcaccgcgggccacgggcagatcgacaacttcagcctcggcatcctgggcatggccctgttcctcgaggagatgctgcgcacgcgggtggggaccaagcacgccatcctgctcgtggccgtctccttcctgaccctgatcaccggcaacatgagcttccgcgacctcgggcgcgtgatggtgatggtcggcgcgacgatgaccgacgacatcgggatgggcgtgacctacctggccctgctcgccgccttcaaggtgcggcccaccttcgccgcgggcctgctgctccgcaagctgacgtccaaggagctgatgatgaccaccatcgggatcgtcctcctgagccagtccagcatccccgagaccatcctggagctcacggacgccctggccctgggcatgatggtgctcaagatggtgcggaacatggagaagtaccagctggccgtcaccatcatggccatcctgtgcgtgcccaacgcggtgatcctccagaacgcctggaaggtctcctgcaccaccctggccgtggtcagcgtgtccccgctgctcctgacgagctcccagcagaaggccgactggatccccctggccctcaccatcaaggggctgaaccccaccgcgatcttcctgaccacgctcacccgcaccagcaagaagcggtcctggcccctgaacgaggccatcatggccgtgggcatggtcagcatcctggcctccagcctcctgaagaacgacatcccgatgaccggccccctggtggccggcgggctcctgacggtgtgctacgtcctgaccgggcgcagcgccgacctcgagctggagcgggccaccgacgtgaagtgggacgaccaggccgagatctccgggagctcccccatcctgagcatcaccatctccgaggacgggagcatgtccatcaagaacgaggaggaggagcagaccctcacgatcctgatccgcaccggcctgctcgtgatcagcggcctgttccccgtctccatcccgatcaccgccgcggcctggtacctgtgggaggtgaagaagcagcgggccggggtgctctgggacgtcccctccccgccgcccgtgggccgcgccgagctggaggacggggcctaccggatcaagcagaagggcatcctggggtactcccagatcggcgcgggcgtgtacaaggaggggaccttccacacgatgtggcacgtcacccgcggcgccgtgctcatgcacaaggggaagcggatcgagcccagctgggccgacgtgaagaaggacctgatctcctacggcgggggctggaagctggagggcgagtggaaggagggggaggaggtccaggtgctcgccctggagcccggcaagaacccccgcgccgtgcagaccaagcccgggctgttccggaccaacacgggcaccatcggggcggtcagcctcgacttctcccccggcaccagcggctcccccatcgtggacaagaaggggaaggtggtcggcctgtacgggaacggcgtggtgacccgcggcggggcctacgtcagcgccatcgcccagacggagaagggcatcgaggacaacccggagatcgaggacgacatcttccggaagcgccggctgaccatcatggacctgcaccccggggccggcaagaccaagcgctacctccccgcgatcgtgcgggaggccatcaagcgcgggctgcgcaccctgatcctcgcccccacgcgggtggtcgccgcggagatggaggaggccctgcgcggcctgccgatccggtaccagacccccgccatccgcgccgagcacaccggccgggagatcgtggacctcatgtgccacgccaccttcacgatgcgcctgctgtcccccatccgggtgcccaactacaacctcatcatcatggacgaggcgcacttcaccgacccggccagcatcgccgcccgcgggtacatcagcacccgggtcgagatgggcgaggccgcggggatcttcatgaccgccacgccgcccggctcccgcgaccccttcccgcagagcaacgcccccatcatggacgaggagcgggagatccccgagcgctcctggaacagcgggcacgagtgggtgaccgacttcaagggcaagaccgtgtggttcgtcccctccatcaagaccggcaacgacatcgccgcctgcctgcggaagaacgggaagcgcgtgatccagctgagccggaagacgttcgactccgagtacgtgaagacccgcaccaacgactgggacttcgtcgtgaccacggacatcagcgagatgggcgcgaacttcaaggccgagcgggtgatcgacccgcgccggtgcatgaagcccgtcatcctcaccgacggggaggagcgcgtgatcctggccggccccatgcccgtgacccactccagcgccgcgcagcgccgggggcgcatcggccggaacccgcgcaacgagaacgaccagtacatctacatgggcgagcccctggagaacgacgaggactgcgcccactggaaggaggccaagatgctcctggacaacatcaacacccccgaggggatcatcccctccatgttcgagccggagcgggagaaggtcgacgccatcgacggcgagtaccgcctgcgcggggaggcccgcaagacgttcgtggacctcatgcggcgcggcgacctgcccgtgtggctggcgtacaaggtcgccgccgaggggatcaactacgccgaccggcgctggtgcttcgacggcacccggaacaaccagatcctcgaggagaacgtggaggtggagatctggaccaaggagggcgagcgcaagaagctgaagccccggtggctggacgcccgcatctacagcgacccgctcgcgctgaaggagttcaaggagttcgccgccgggcggaagtccctgaccctcaacctgatcacggagatgggccgcctgcccaccttcatgacccagaaggcccgggacgccctcgacaacctggcggtcctgcacaccgccgaggccgggggcaaggcctacaaccacgcgctcagcgagctgcccgagaccctggagacgctcctgctgctcaccctgctggccaccgtgaccggcgggatcttcctcttcctgatgtccggccgcgggatcggcaagatgacgctggggatgtgctgcatcatcaccgccagcatcctcctgtggtacgcccagatccagccccactggatcgccgcgtccatcatcctggagttcttcctcatcgtcctgctgatcccggagcccgagaagcagcggacgccccaggacaaccagctcacctacgtgatcatcgccatcctgacggtggtcgccgccaccatggccaacgagatgggcttcctggagaagaccaagaaggacctcggcctggggcacatcgcgacccagcagcccgagagcaacatcctggacatcgacctccgcccggcctccgcctggacgctgtacgccgtggccaccaccttcatcacccccatgctgcgccacagcatcgagaacagctccgtgaacgtcagcctcacggcgatcgccaaccaggccaccgtgctgatgggcctggggaagggctggcccctctccaagatggacatcggggtgcccctgctggccatcggctgctacagccaggtcaacccgatcaccctcaccgccgcgctgctgatgctcgtggcccactacgccatcatcggccccgggctgcaggccaaggcgacgcgggaggcccagaagcgcgccgccgccggcatcatgaagaaccccaccgtggacgggatcaccgtcatcgacctggaccccatcccgtacgaccccaagttcgagaagcagctcggccaggtgatgctgctggtgctctgcgtcacccaggtgctgatgatgcggacgacctgggcgctgtgcgaggccctcaccctggccaccgggcccgtgtccacgctgtgggagggcaaccccggccgcttctggaacaccaccatcgccgtcagcatggccaacatcttccgggggtcctacctcgcgggcgccgggctgctgttcagcatcatgaagaacaccacgtccacccgccggggcaccggcaacatgggggagaccctcggcgagaagtggaagaaccgcctgaacgccctgggcaagagcgagttccagatctacaagaagtccggcatccaggaggtggaccggacgctcgccaaggaggggatcaagcgcggcgagaccgaccaccacgccgtgagccggggctccgcgaagctgcgctggttcgtcgagcggaacctggtgaccccggaggggaaggtggtcgacctcggctgcgggcgcggcgggtggagctactactgcggcggcctgaagaacgtgcgggaggtgaaggggctgaccaagggcgggcccggccacgaggagcccatccccatgtccacctacgggtggaacctcgtccgcctgcagagcggcgtggacgtgttcttcgtcccgcccgagaagtgcgacacgctgctctgcgacatcggcgagtccagccccaaccccaccgtggaggccgggcggaccctgcgcgtgctgaacctcgtcgagaactggctgaacaacaacacccagttctgcgtgaaggtgctgaacccgtacatgccctccgtcatcgagcggatggagacgctgcagcgcaagtacggcggggccctcgtgcgcaaccccctgagccggaacagcacccacgagatgtactgggtgtccaacgccagcggcaacatcgtctccagcgtgaacatgatctcccgcatgctgatcaaccggttcaccatgcgccacaagaaggcgacctacgagccggacgtggacctcgggagcggcacgcggaacatcggcatcgagtccgagacccccaacctggacatcatcgggaagcgcatcgagaagatcaagcaggagcacgagaccagctggcactacgaccaggaccacccctacaagacctgggcctaccacggctcctacgagacgaagcagaccgggagcgcctccagcatggtcaacggcgtggtgcggctgctcaccaagccctgggacgtcatcccgatggtgacccagatggccatgacggacaccacccccttcggccagcagcgcgtgttcaaggagaaggtcgacacccggacgcaggagcccaaggaggggaccaagaagctgatgaagatcaccgccgagtggctgtggaaggagctcggcaagaagaagacgccccggatgtgcacgcgggaggagttcaccaagaaggtgcgctccaacgcggccctgggggccatcttcaccgacgagaacaagtggaagtccgcccgggaggccgtggaggacaaccgcttctgggagctggtcgacaaggagcggaacctccacctggagggcaagtgcgagacctgcgtgtacaacatgatggggaagcgcgagaagaagctgggcgagttcggcaaggcgaaggggtcccgggccatctggtacatgtggctcggcgcccgcttcctggagttcgaggccctggggttcctcaacgaggaccactggttcagccgggagaactccctgagcggcgtcgagggggagggcctgcacaagctcggctacatcctgcgcgaggtgtccaagaaggagggcggggccatgtacgcggacgacacggccgggtgggacacccggatcaccatcgaggacctgaagaacgaggagatgatcaccaaccacatggccggcgagcacaagaagctcgccgaggcgatcttcaagctgacgtaccagaacaaggtggtccgcgtgcagcgcccgacgccccgggggaccgtgatggacatcatcagccgccgggaccagcgcggcagcggccaggtcgtgacctacgggctgaacaccttcaccaacatggaggcccagctcatccggcagatggagggcgagggggtgttcaagtccatccagcacctgaccgccagcgaggagatcgccgtccaggactggctggtgcgcgtgggccgggagcgcctctcccggatggccatcagcggcgacgactgcgtcgtgaagcccctggacgaccgcttcgcgaaggccctgaccgccctcaacgacatggggaaggtgcggaaggacatccagcagtgggagccctcccgcggctggaacgactggacccaggtcccgttctgcagccaccacttccacgagctgatcatgaaggacgggcggacgctggtggtgccctgccgcaaccaggacgagctcatcggccgggcccgcatctcccagggggccggctggagcctgcgggagaccgcgtgcctgggcaagtcctacgcccagatgtggagcctcatgtacttccaccgccgggacctgcgcctggccgccaacgccatctgctccgcggtccccagccactgggtgcccacctcccgcaccacgtggagcatccacgcctcccacgagtggatgaccaccgaggacatgctcaccgtgtggaaccgggtctggatcctggagaacccgtggatggaggacaagacgcccgtggagagctgggaggagatcccctacctggggaagcgcgaggaccagtggtgcggctccctcatcgggctgaccagccgggccacctgggccaagaacatccagaccgccatcaaccaggtgcgcagcctgatcggcaacgaggagtacacggactacatgccctccatgaagcggttccgccgggaggaggaggaggcgggggtcctctggtga

SEQ ID NO: 9780 - RNA, 9876 nt, synthetic construct
  misc_feature 1..9876: note = derived and/or modified CDS sequence (opt1) from DENV-2__DQ645545__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccgcaccgagacctggatgtccagccagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgggaaggactcccccgtcaacatcgaggccgagccgcccttcggcgacagctacatcatcatcggggtggagccgggccagctgaagctgtcctggttcaagaaggggagctccatcggccagatgttcgagaccaccatgcgcggcgccaagcggatggccatcctcggggacacggcctgggacttcggcagcctcgggggcgtgttcacctccatcgggaaggcgctgcaccaggtcttcggcgccatctacggcgccgccttcagcggggtgtcctggaccatgaagatcctcatcggcgtggtcatcacctggatcgggatgaacagccgctccacgagcctgtccgtgagcctggtgctggtcggcgtggtgaccctctacctgggggtcatggtgcaggcggactccggctgcgtggtcagctggaagaacaaggagctgaagtgcggcagcgggatcttcatcaccgacaacgtgcacacctggacggagcagtacaagttccagcccgagtcccccagcaagctcgcctccgccatccagaaggcccacgaggagggcatctgcgggatccggagcgtgacccgcctggagaacctgatgtggaagcagatcacccccgagctcaaccacatcctgtccgagaacgaggtcaagctgaccatcatgacgggcgacatcaaggggatcatgcaggccggcaagcggagcctccgcccgcagcccaccgagctgaagtactcctggaaggcgtggggcaaggccaagatgctgagcaccgagctccacaaccacaccttcctgatcgacgggcccgagacggccgagtgcccgaacaccaaccgggcctggaactccctggaggtggaggactacggcttcggggtgttcaccaccaacatctggctcaagctgaaggagcgccaggacgtcttctgcgacagcaagctgatgtccgccgcgatcaaggacaaccgggccgtgcacgccgacatgggctactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcggggcccgtgagccagcacaactaccgcccgggctaccacacccagaccgccgggccctggcacctcggcaagctggagatggacttcgacttctgcgaggggaccacggtggtcgtgaccgaggactgcggcaaccggggccccagcctgcgcaccaccacggcctccgggaagctcatcaccgagtggtgctgccggagctgcaccctgcccccgctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggcgctgttcctcgaggagatgctgcggacgcgcgtgggcaccaagcacgccatcctgctcgtcgccgtgtccttcgtgaccctgatcaccgggaacatgagcttccgggacctgggccgcgtcatggtgatggtgggggccacgatgaccgacgacatcggcatgggcgtcacctacctcgccctgctggcggccttcaaggtgcgccccaccttcgccgccgggctcctgctgcggaagctcacgtccaaggagctgatgatgaccaccatcggcatcgtcctgctcagccagtccaccatccccgagacgatcctggagctgaccgacgccctcgcgctggggatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaagggcctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccgggcccctggtcgccggcgggctgctcaccgtgtgctacgtgctgacgggccggagcgccgacctggagctcgagcgcgcggccgacgtccggtgggaggagcaggccgagatctccgggagctcccccatcctgagcatcaccatctccgaggacggcagcatgtccatcaagaacgaggaggaggagcagaccctgaccatcctcatccgcacgggcctgctggtgatcagcgggctgttcccggtgtccatccccatcaccgccgccgcgtggtacctgtgggaggtcaagaagcagcgggccggcgtgctgtgggacgtgcccagcccgccgcccgtcgggaaggccgagctcgaggacggcgcctaccgcatcaagcagaaggggatcctgggctactcccagatcggcgccggggtgtacaaggagggcaccttccacaccatgtggcacgtgacccgcggggcggtcctgatgcacaagggcaagcgcatcgagcccagctgggccgacgtgaagaaggacctcatctcctacgggggcggctggaagctggagggggagtggaaggagggcgaggaggtgcaggtcctggccctcgagcccgggaagaacccccgggccgtgcagacgaagcccggcctgttcaagaccaacaccgggaccatcggcgccgtgagcctggacttctcccccggcacgagcgggtcccccatcgtcgacaagaagggcaaggtggtggggctctacggcaacggcgtcgtgacccgcagcgggacctacgtgtccgcgatcgcccagaccgagaagtccatcgaggacaaccccgagatcgaggacgacatcttccggaagaagcgcctgacgatcatggacctgcaccccggcgccgggaagaccaagcggtacctgcccgccatcgtccgcgaggcgatcaagcggggcctccgcaccctgatcctggccccgacccgggtggtggccgccgagatggaggaggccctccgcgggctgcccatccgctaccagacgcccgcgatccgggccgagcacaccggccgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtcacggacttcaaggggaagaccgtgtggttcgtgccgtccatcaaggccggcaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggggcgaacttcaaggccgagcgggtgatcgacccccgccggtgcatgaagcccgtgatcctgaccgacggcgaggagcgcgtcatcctcgccgggcccatgccggtgacgcactccagcgccgcccagcggcgcggccgggtcgggcgcaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgcgagaaggtggacgccatcgacggggagtaccggctgcgcggcgaggcccggaagaccttcgtggacctgatgcgccgcggggacctccccgtctggctggcctaccgcgtggcggccgagggcatcaactacgccgaccggcgctggtgcttcgacggggtgaagaacaaccagatcctggaggagaacgtcgaggtggagatctggaccaaggagggcgagcggaagaagctcaagccgcgctggctggacgcccggatctacagcgaccccctggccctcaaggagttcaaggagttcgcggccggccgcaagtccctgacgctgaacctcatcaccgagatggggcggctgcccaccttcatgacccagaaggcccgcaacgccctggacaacctcgcggtgctgcacacggccgaggccggcgggcgggcctacaaccacgccctgagcgagctccccgagaccctggagaccctgctcctgctgaccctcctggcgacggtcaccggcggcatcttcctgttcctcatgtccgggaagggcatcgggaagatgaccctgggcatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatggggttcctggagaagaccaagaaggacttcggcctgggcgggatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatgggcctcgggaagggctggcccctgtccaagatggacatcggggtgccgctgctcgccatcggctgctacagccaggtcaaccccatcaccctgacggccgcgctgctcctgctggtggcccactacgccatcatcggccccgggctccaggccaaggccacccgggaggcgcagaagcgcgccgccgccggcatcatgaagaaccccaccgtggacgggatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacggggcccatctccaccctgtgggagggcaacccgggccgcttctggaacaccaccatcgccgtgagcatggccaacatcttccgcgggtcctacctggccggcgcggggctcctgttcagcatcatgaagaacacggccaacacccggcgcggcaccggcaacaccggggagacgctgggcgagaagtggaagaaccggctcaacgccctggggaagtccgagttccagatctacaagaagtccggcatccaggaggtcgaccgcaccctggccaaggaggggatcaagcggggcgagaccgaccaccacgcggtgtcccgcggcagcgccaagctccggtggttcgtggagcgcaacctggtcacccccgaggggaaggtgatggacctgggctgcgggcggggcgggtggtcctactactgcggcggcctcaagaacgtgaaggaggtcaaggggctgacgaagggcgggcccggccacgaggagcccatcccgatgagcacctacgggtggaacctggtgcgcctccagtccggcgtggacgtcttcttcacgccgcccgagaagtgcgacaccctgctgtgcgacatcggcgagagctcccccaacccgacggtggaggccgggcggaccctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctcagccggaactccacccacgagatgtactgggtgagcaacgcgtccggcaacatcgtgagctccgtcaacatgatcagccgcatgctgatcaaccggttcaccatgcgccacaagaaggccacgtacgagcccgacgtggacctggggtccggcacccggaacatcggcatcgagagcgagacccccaacctcgacatcatcgggaagcgcatcgagaagatcaagcaggagcacgagacctcctggcactacgaccaggaccacccctacaagacgtgggcctaccacggcagctacgagaccaagcagaccgggtccgccagctccatggtgaacggcgtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggaggggaccaagaagctcatgaagatcaccgcggagtggctgtggaaggagctgggcaagaagaagacgccgcggatgtgcacccgcgaggagttcacccggaaggtgcgcagcaacgccgccctcggggccatcttcaccgacgagaacaagtggaagtccgcccgggaggcggtggaggacagcggcttctgggagctggtcgacaaggagcgcaacctgcacctcgaggggaagtgcgagacgtgcgtgtacaacatgatgggcaagcgggagaagaagctgggcgagttcgggaaggccaagggctcccgcgccatctggtacatgtggctgggggcccggttcctcgagttcgaggcgctgggcttcctgaacgaggaccactggttcagccgcgagaactccctcagcggggtggagggcgagggcctgcacaagctggggtacatcctccgggacgtcagcaagaaggagggcggggccatgtacgccgacgacaccgccggctgggacacccgcatcaccctggaggacctgaagaacgaggagatggtgacgaaccacatggagggggagcacaagaagctcgccgaggcgatcttcaagctgacctaccagaacaaggtggtccgggtgcagcgccccacgccccggggcaccgtgatggacatcatctcccgccgggaccagcgcggcagcgggcaggtcgtgacgtacggcctgaacaccttcaccaacatggaggcccagctcatccggcagatggagggggagggcgtgttcaagtccatccagcagctgaccgccacggaggagatcgccgtcaagaactggctggcccgcgtgggccgcgagcggctcagccgcatggcgatctccggggacgactgcgtggtcaagcccctggacgaccggttcgccagcgccctgaccgccctcaacgacatgggcaaggtgcgcaaggacatccagcagtgggagccgtcccgggggtggaacgactggacccaggtgcccttctgcagccaccacttccacgagctgatcatgaaggacggccgcgtcctggtggtgccctgccggaaccaggacgagctcatcgggcgcgcccggatctcccagggcgcgggctggagcctgcgcgagaccgcctgcctggggaagtcctacgcccagatgtggagcctcatgtacttccaccggcgcgacctgcggctggccgccaacgcgatctgctccgccgtccccagccactgggtgccgacgtcccgcaccacctggagcatccacgccacccacgagtggatgaccacggaggacatgctcaccgtgtggaaccgggtctggatccaggagaacccctggatcgaggacaagacccccgtggagtcctgggaggagatcccctacctgggcaagcgcgaggaccagtggtgcgggagcctgatcggcctcaccagccgggccacgtgggcgaagaacatccagaccgccatcaaccaggtgcgctccctgatcgggaacgaggagtacaccgactacatgccgagcatgaagcggttccgccgcgaggaggaggaggccggcgtcctgtggtga

SEQ ID NO: 9781 - RNA, 9876 nt, synthetic construct
  misc_feature 1..9876: note = derived and/or modified CDS sequence (opt1) from DENV-2__DQ645546__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcttctggaacaccaccatcgccgtgagcatggccaacatcttccgcggctcctacctggccggggcgggcctcctgttcagcatcatgaagaacacggccaacacccggcgcgggaccggcaacaccggcgagacgctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacccccgagggcaaggtgatggacctggggtgcggccgcggcgggtggtcctactactgcggcgggctcaagaacgtgaaggaggtcaaggggctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagctcccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtggaggacagcgggttctgggagctggtcgacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggggccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtggtccgggtgcagcgccccacgccccgggggaccgtgatggacatcatctcccgccgggaccagcgcggcagcggccaggtcgtgacgtacgggctgaacaccttcaccaacatggaggcccagctcatccggcagatggagggcgagggggtgttcaagtccatccagcagctgaccgccacggaggagatcgccgtcaagaactggctggcccgcgtgggccgcgagcggctcagccgcatggcgatctccggcgacgactgcgtggtcaagcccctggacgaccggttcgccagcgccctgaccgccctcaacgacatggggaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtccccagccactgggtgccgacgtcccgcaccacctggagcatccacgccacccacgagtggatgaccacggaggacatgctcaccgtgtggaaccgggtctggatccaggagaacccctggatcgaggacaagacccccgtggagtcctgggaggagatcccctacctggggaagcgcgaggaccagtggtgcggcagcctgatcgggctcaccagccgggccacgtgggcgaagaacatccagaccgccatcaaccaggtgcgctccctgatcggcaacgaggagtacaccgactacatgccgagcatgaagcggttccgccgcgaggaggaggaggccggggtcctgtggtga

SEQ ID NO: 9782 - RNA, 9876 nt, synthetic construct
  misc_feature 1..9876: note = derived and/or modified CDS sequence (opt1) from DENV-2__DQ645547__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagtacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcttctggaacaccaccatcgccgtgagcatggccaacatcttccgcggctcctacctggccggggcgggcctcctgttcagcatcatgaagaacacggccaacacccggcgcgggaccggcaacaccggcgagacgctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacccccgagggcaaggtgatggacctggggtgcggccgcggcgggtggtcctactactgcggcgggctcaagaacgtgaaggaggtcaaggggctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagctcccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtggaggacagcgggttctgggagctggtcgacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggggccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtggtccgggtgcagcgccccacgccccgggggaccgtgatggacatcatctcccgccgggaccagcgcggcagcggccaggtcgtgacgtacgggctgaacaccttcaccaacatggaggcccagctcatccggcagatggagggcgagggggtgttcaagtccatccagcagctgaccgccacggaggagatcgccgtcaagaactggctggcccgcgtgggccgcgagcggctcagccgcatggcgatctccggcgacgactgcgtggtcaagcccctggacgaccggttcgccagcgccctgaccgccctcaacgacatggggaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtccccagccactgggtgccgacgtcccgcaccacctggagcatccacgccacccacgagtggatgaccacggaggacatgctcaccgtgtggaaccgggtctggatccaggagaacccctggatcgaggacaagacccccgtggagtcctgggaggagatcccctacctggggaagcgcgaggaccagtggtgcggcagcctgatcgggctcaccagccgggccacgtgggcgaagaacatccagaccgccatcaaccaggtgcgctccctgatcggcaacgaggagtacaccgactacatgccgagcatgaagcggttccgccgcgaggaggaggaggccggggtcctgtggtga

SEQ ID NO: 9783 - RNA, 9876 nt, synthetic construct
  misc_feature 1..9876: note = derived and/or modified CDS sequence (opt1) from DENV-2__DQ645549__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcttctggaacaccaccatcgccgtgagcatggccaacatcttccgcggctcctacctggccggggcgggcctcctgttcagcatcatgaagaacacggccaacacccggcgcgggaccggcaacaccggcgagacgctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacccccgagggcaaggtgatggacctggggtgcggccgcggcgggtggtcctactactgcggcgggctcaagaacgtgaaggaggtcaaggggctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagctcccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggtcaaggtggacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtcgaggacagcgggttctgggagctggtggacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtcgagggggagggcctgcacaagctgggctacatcctccgggacgtgagcaagaaggagggcggggccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtcgtgcgggtgcagcgccccacgccccgggggaccgtcatggacatcatctcccgccgggaccagcgcggcagcggccaggtggtgacgtacgggctgaacaccttcaccaacatggaggcccagctcatccggcagatggagggcgagggggtcttcaagtccatccagcagctgaccgccacggaggagatcgccgtgaagaactggctggcccgcgtgggccgcgagcggctcagccgcatggcgatctccggcgacgactgcgtcgtgaagcccctggacgaccggttcgccagcgccctgaccgccctcaacgacatggggaaggtgcgcaaggacatccagcagtgggagccgtcccggggctggaacgactggacccaggtccccttctgcagccaccacttccacgagctgatcatgaaggacgggcgcgtgctggtggtcccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtgcccagccactgggtgccgacgtcccgcaccacctggagcatccacgccacccacgagtggatgaccacggaggacatgctcaccgtctggaaccgggtgtggatccaggagaacccctggatcgaggacaagacccccgtggagtcctgggaggagatcccctacctggggaagcgcgaggaccagtggtgcggcagcctgatcgggctcaccagccgggccacgtgggcgaagaacatccagaccgccatcaaccaggtccgctccctgatcggcaacgaggagtacaccgactacatgccgagcatgaagcggttccgccgcgaggaggaggaggccggggtgctgtggtga

SEQ ID NO: 9784 - RNA, 9876 nt, synthetic construct
  misc_feature 1..9876: note = derived and/or modified CDS sequence (opt1) from DENV-2__DQ645550__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcctgtggaacaccaccatcgccgtgagcatggccaacatcttccgcggctcctacctcgccggggcgggcctgctgttcagcatcatgaagaacacggccaacacccggcgcgggaccggcaacaccggcgagacgctcggggagaagtggaagaaccggctgaacgccctgggcaagtccgagttccagatctacaagaagtccgggatccaggaggtcgaccgcaccctcgccaaggagggcatcaagcgcggggagaccgaccaccacgcggtgtcccgcggcagcgccaagctgcggtggttcgtggagcgcaacctggtcacccccgagggcaaggtgatggacctcgggtgcggccgcggcgggtggtcctactactgcggcgggctgaagaacgtgaaggaggtcaaggggctgacgaagggcgggcccgggcacgaggagcccatcccgatgagcacctacggctggaacctcgtgcgcctgcagtccggggtggacgtcttcttcacgccgcccgagaagtgcgacaccctgctctgcgacatcggcgagagctcccccaacccgacggtggaggccggccggaccctgcgcgtgctgaacctcgtcgagaactggctgaacaacaacacccagttctgcatcaaggtgctgaacccctacatgcccagcgtgatcgagaagatggaggccctgcagcggaagtacgggggcgccctcgtccgcaacccgctgagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctcggctccgggacccggaacatcggcatcgagagcgagacccccaacctggacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctcaccaagccgtgggacgtcatccccatggtgacgcagatggccatgaccgacaccacccccttcggccagcagcgggtgttcaaggtcaaggtggacacgcgcacccaggagcccaaggagggcaccaagaagctgatgaagatcaccgcggagtggctgtggaaggagctcgggaagaagaagacgccgcggatgtgcacccgcgaggagttcacccggaaggtgcgcagcaacgccgccctgggcgccatcttcaccgacgagaacaagtggaagtccgcccgggaggcggtcgaggacagcgggttctgggagctggtggacaaggagcgcaacctccacctggagggcaagtgcgagacgtgcgtgtacaacatgatggggaagcgggagaagaagctgggcgagttcggcaaggccaaggggtcccgcgccatctggtacatgtggctcggcgcccggttcctggagttcgaggcgctggggttcctcaacgaggaccactggttcagccgcgagaactccctgagcggcgtcgagggggagggcctgcacaagctcggctacatcctgcgggacgtgagcaagaaggagggcggggccatgtacgccgacgacaccgccgggtgggacacccgcatcaccctggaggacctcaagaacgaggagatggtgacgaaccacatggagggcgagcacaagaagctggccgaggcgatcttcaagctgacctaccagaacaaggtcgtgcgggtgcagcgccccacgccccgggggaccgtcatggacatcatctcccgccgggaccagcgcggcagcggccaggtggtgacgtacgggctcaacaccttcaccaacatggaggcccagctgatccggcagatggagggcgagggggtcttcaagtccatccagcagctgaccgccacggaggagatcgccgtgaagaactggctcgcccgcgtgggccgcgagcggctgagccgcatggcgatctccggcgacgactgcgtcgtgaagcccctggacgaccggttcgccagcgccctcaccgccctgaacgacatggggaaggtgcgcaaggacatccagcagtgggagccgtcccggggctggaacgactggacccaggtccccttctgcagccaccacttccacgagctgatcatgaaggacgggcgcgtgctcgtggtcccctgccggaaccaggacgagctgatcggccgcgcccggatctcccagggggcgggctggagcctgcgcgagaccgcctgcctcggcaagtcctacgcccagatgtggagcctgatgtacttccaccggcgcgacctgcggctcgccgccaacgcgatctgctccgccgtgcccagccactgggtgccgacgtcccgcaccacctggagcatccacgccacccacgagtggatgaccacggaggacatgctgaccgtctggaaccgggtgtggatccaggagaacccctggatcgaggacaagacccccgtggagtcctgggaggagatcccctacctggggaagcgcgaggaccagtggtgcggcagcctcatcgggctgaccagccgggccacgtgggcgaagaacatccagaccgccatcaaccaggtccgctccctgatcggcaacgaggagtacaccgactacatgccgagcatgaagcggttccgccgcgaggaggaggaggccggggtgctctggtga

SEQ ID NO: 9785 - RNA, 9876 nt, synthetic construct
  misc_feature 1..9876: note = derived and/or modified CDS sequence (opt1) from DENV-2__DQ645551__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacaccgaccggcgctggtgcttcgacggcgtgaagaacaaccagatcctggaggagaacgtcgaggtggagatctggacgaaggagggggagcggaagaagctcaagccgcgctggctggacgcccggatctacagcgaccccctggccctcaaggagttcaaggagttcgccgcgggccgcaagtccctgaccctgaacctcatcaccgagatgggccggctgcccaccttcatgacgcagaaggcccgcaacgccctggacaacctcgccgtgctgcacaccgcggaggccgggggccgggcctacaaccacgccctgagcgagctccccgagaccctggagaccctgctcctgctgacgctcctggccaccgtcaccgggggcatcttcctgttcctcatgtccggcaaggggatcggcaagatgaccctggggatgtgctgcatcatcaccgcgagcgtgctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgccatcctcaccgtggtcgcggccaccatggccaacgagatgggcttcctggagaagacgaagaaggacttcgggctgggcggcatcgccacccagcagccggagagcaacatcctcgacatcgacctgcggcccgccagcgcgtggaccctgtacgccgtggccaccacgttcatcacccccatgctccgccactccatcgagaacagctccgtgaacgtcagcctgaccgccatcgccaaccaggcgaccgtgctgatggggctcggcaaggggtggcccctgtccaagatggacatcggcgtgccgctgctcgccatcgggtgctacagccaggtcaaccccatcacgctgaccgccgccctgctcctgctggtggcgcactacgccatcatcggccccggcctccaggccaaggccacccgggaggcccagaagcgcgcggccgccgggatcatgaagaaccccaccgtggacggcatcacggtcatcgacctggacccgatcccctacgaccccaagttcgagaagcagctgggccaggtgatgctcctggtgctgtgcgtcacccaggtgctcatgatgcggaccacctgggccctgtgcgaggccctgacgctcgcgaccggccccatctccaccctgtgggaggggaacccgggccgcttctggaacaccacgatcgccgtgagcatggccaacatcttccgcggctcctacctggccggggccggcctcctgttcagcatcatgaagaacaccgcgaacacccggcgcgggaccggcaacacgggcgagaccctgggggagaagtggaagaaccggctcaacgccctgggcaagtccgagttccagatctacaagaagtccgggatccaggaggtcgaccgcaccctggccaaggagggcatcaagcgcggggagaccgaccaccacgccgtgtcccgcggcagcgcgaagctccggtggttcgtggagcgcaacctggtcacgcccgagggcaaggtgatggacctggggtgcggccgcggcgggtggtcctactactgcggcgggctcaagaacgtgaaggaggtcaaggggctgaccaagggcgggcccgggcacgaggagcccatcccgatgagcacctacggctggaacctggtgcgcctccagtccggggtggacgtcttcttcacgccgcccgagaagtgcgacacgctgctgtgcgacatcggcgagagctcccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcctccgggaacatcgtgagctccgtcaacatgatcagccgcatgctgatcaaccggttcacgatgcgccacaagaaggcgacctacgagcccgacgtggacctgggctccgggacccggaacatcggcatcgagagcgagacccccaacctcgacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtcgtgcgcctgctgacgaagccgtgggacgtcatccccatggtgacccagatggccatgaccgacaccacgcccttcggccagcagcgggtgttcaaggagaaggtcgacacccgcacccaggagcccaaggagggcaccaagaagctcatgaagatcacggccgagtggctgtggaaggagctggggaagaagaagaccccgcggatgtgcacccgcgaggagttcacccggaaggtgcgcagcaacgcggccctcggcgccatcttcacggacgagaacaagtggaagtccgcccgggaggccgtggaggacagcgggttctgggagctggtcgacaaggagcgcaacctgcacctcgagggcaagtgcgagacctgcgtgtacaacatgatggggaagcgggagaagaagctgggcgagttcggcaaggcgaaggggtcccgcgccatctggtacatgtggctgggcgcccggttcctcgagttcgaggccctggggttcctgaacgaggaccactggttcagccgcgagaactccctcagcggcgtggagggggagggcctgcacaagctgggctacatcctccgggacgtcagcaagaaggagggcggggcgatgtacgccgacgacaccgccgggtgggacacccgcatcacgctggaggacctgaagaacgaggagatggtgaccaaccacatggagggcgagcacaagaagctcgccgaggccatcttcaagctgacctaccagaacaaggtggtccgggtgcagcgccccacgccccgggggacggtgatggacatcatctcccgccgggaccagcgcggcagcggccaggtcgtgacctacgggctgaacaccttcaccaacatggaggcgcagctcatccggcagatggagggcgagggggtgttcaagtccatccagcagctgacggccaccgaggagatcgccgtcaagaactggctggcccgcgtgggccgcgagcggctcagccgcatggccatctccggcgacgactgcgtggtcaagcccctggacgaccggttcgcgagcgccctgaccgccctcaacgacatggggaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggccggctggagcctgcgcgagacggcgtgcctgggcaagtcctacgcccagatgtggagcctcatgtacttccaccggcgcgacctgcggctggccgccaacgccatctgctccgcggtccccagccactgggtgccgacctcccgcaccacctggagcatccacgccacccacgagtggatgacgaccgaggacatgctcaccgtgtggaaccgggtctggatccaggagaacccctggatcgaggacaagacccccgtggagtcctgggaggagatcccctacctggggaagcgcgaggaccagtggtgcggcagcctgatcgggctcacgagccgggccacctgggccaagaacatccagaccgcgatcaaccaggtgcgctccctgatcggcaacgaggagtacaccgactacatgccgagcatgaagcggttccgccgcgaggaggaggaggccggggtcctgtggtga

SEQ ID NO: 9786 - RNA, 9876 nt, synthetic construct
  misc_feature 1..9876: note = derived and/or modified CDS sequence (opt1) from DENV-2__DQ645552__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcacgatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcttctggaacaccaccatcgccgtgagcatggccaacatcttccgcggctcctacctggccggggcgggcctcctgttcagcatcatgaagaacacggccaacacccggcgcgggaccggcaacaccggcgagacgctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacccccgagggcaaggtgatggacctggggtgcggccgcggcgggtggtcctactactgcggcgggctcaagaacgtgaaggaggtcaaggggctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagctcccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtggaggacagcgggttctgggagctggtcgacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggggccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtggtccgggtgcagcgccccacctcccgggggaccgtgatggacatcatcagccgccgggaccagcgcggctccggccaggtcgtgacgtacgggctgaacaccttcaccaacatggaggcccagctcatccggcagatggagggcgagggggtgttcaagagcatccagcagctgaccgccacggaggagatcgccgtcaagaactggctggcccgcgtgggccgcgagcggctctcccgcatggcgatcagcggcgacgactgcgtggtcaagcccctggacgaccggttcgcctccgccctgaccgccctcaacgacatggggaaggtgcgcaaggacatccagcagtgggagcccagccggggctggaacgactggacccaggtgccgttctgctcccaccacttccacgagctgatcatgaaggacgggcgcgtcctggtggtgccctgccggaaccaggacgagctcatcggccgcgcccggatcagccagggggcgggctggtccctgcgcgagaccgcctgcctgggcaagagctacgcccagatgtggtccctcatgtacttccaccggcgcgacctgcggctggccgccaacgcgatctgcagcgccgtcccctcccactgggtgcccacgagccgcaccacctggtccatccacgccacccacgagtggatgaccacggaggacatgctcaccgtgtggaaccgggtctggatccaggagaacccgtggatcgaggacaagacccccgtggagagctgggaggagatcccctacctggggaagcgcgaggaccagtggtgcggcagcctgatcgggctcacctcccgggccacgtgggcgaagaacatccagaccgccatcaaccaggtgcgcagcctgatcggcaacgaggagtacaccgactacatgccctccatgaagcggttccgccgcgaggaggaggaggccggggtcctgtggtga

SEQ ID NO: 9787 - RNA, 9876 nt, synthetic construct
  misc_feature 1..9876: note = derived and/or modified CDS sequence (opt1) from DENV-2__DQ645553__SS-prME
  source 1..9876: mol_type = other RNA
accgccggggtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcacgatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagccccggcggggtgttcacctccatcggcaaggcgctgcaccaggtcttcggggccatctacggcgccgccttcagcggcgtgtcctggaccatgaagatcctgatcggggtggtcatcacctggatcggcatgaacagccgctccacgagcctctccgtgagcctggtgctggtcggggtggtgaccctgtacctcggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctggcctccgccatccagaaggcccacgaggaggggatctgcggcatccggagcgtgacccgcctcgagaacctgatgtggaagcagatcaccccggagctgaaccacatcctctccgagaacgaggtcaagctgaccatcatgacgggggacatcaagggcatcatgcaggccgggaagcggagcctgcgcccccagcccaccgagctcaagtactcctggaaggcgtggggcaaggccaagatgctgagcaccgagctgcacaaccacaccttcctcatcgacggcccggagacggccgagtgccccaacaccaaccgggcctggaactccctggaggtggaggactacgggttcggcgtgttcaccaccaacatctggctgaagctcaaggagcgccaggacgtcttctgcgacagcaagctgatgtccgccgcgatcaaggacaaccgggccgtgcacgccgacatggggtactggatcgagagcgccctgaacgacacgtggaagatcgagaaggcctccttcatcgaggtcaagagctgccactggcccaagtcccacaccctctggagcaacggcgtgctggagtccgagatgatcatccccaagaacttcgcgggcccggtgagccagcacaactaccgccccgggtaccacacccagaccgccggcccctggcacctggggaagctcgagatggacttcgacttctgcgagggcaccacggtggtcgtgaccgaggactgcgggaaccggggccccagcctgcgcaccaccacggcctccggcaagctgatcaccgagtggtgctgccggagctgcaccctcccgcccctgcgctaccgcggggaggacggctgctggtacgggatggagatccgccccctgaaggagaaggaggagaacctcgtgaactccctggtcaccgccggccacgggcagatcgacaacttcagcctgggcgtgctcggcatggcgctgttcctggaggagatgctccggacgcgcgtggggaccaagcacgccatcctgctggtcgccgtgtccttcgtgaccctcatcaccggcaacatgagcttccgggacctggggcgcgtcatggtgatggtgggcgccacgatgaccgacgacatcgggatgggcgtcacctacctggccctcctggcggccttcaaggtgcgccccaccttcgccgccggcctgctcctgcggaagctgacgtccaaggagctcatgatgaccaccatcgggatcgtcctgctgagccagtccaccatcccggagacgatcctcgagctgaccgacgccctggcgctcggcatgatggtgctgaagatcgtgcgcaacatggagaagtaccagctggccgtcaccatcatggccatcctctgcgtgcccaacgccgtgatcctgcagaacgcctggaaggtcagctgcaccatcctggcggtggtgtccgtcagccccctcctgctgacgtccagccagcagaaggccgactggatccccctcgccctgaccatcaaggggctgaacccgaccgccatcttcctcaccacgctgtcccggaccagcaagaagcgctcctggcccctgaacgaggcgatcatggccgtgggcatggtgagcatcctcgcctccagcctgctgaagaacgacatccccatgaccggccccctcgtcgccgggggcctgctgaccgtgtgctacgtgctcacggggcggagcgccgacctggagctggagcgcgcggccgacgtccggtgggaggagcaggccgagatctccggcagctccccgatcctcagcatcaccatctccgaggacgggagcatgtccatcaagaacgaggaggaggagcagaccctgaccatcctgatccgcacgggcctcctggtgatcagcggcctgttccccgtgtccatccccatcaccgccgccgcgtggtacctctgggaggtcaagaagcagcgggccggggtgctgtgggacgtgcccagcccgccgcccgtcggcaaggccgagctggaggacggggcctaccgcatcaagcagaagggcatcctcgggtactcccagatcggcgccggcgtgtacaaggaggggaccttccacaccatgtggcacgtgacccggggcgcggtcctgatgcacaaggggaagcgcatcgagccgagctgggccgacgtgaagaaggacctgatctcctacggcgggggctggaagctcgagggcgagtggaaggagggggaggaggtgcaggtcctggccctggagcccggcaagaacccccgggccgtgcagacgaagcccggcctgttcaagaccaacaccggcaccatcggggccgtgagcctggacttctccccgggcacgagcggctcccccatcgtcgacaagaaggggaaggtggtgggcctgtacgggaacggcgtcgtgacccgcagcggcacctacgtgtccgcgatcgcccagaccgagaagtccatcgaggacaaccccgagatcgaggacgacatcttccggaagaagcgcctcacgatcatggacctgcaccccggggccggcaagaccaagcggtacctgccggccatcgtccgcgaggcgatcaagcgggggctgcgcaccctcatcctggcccccacccgggtggtggccgccgagatggaggaggccctgcgcggcctccccatccgctaccagacgcccgcgatccgggccgagcacaccgggcgcgagatcgtcgacctgatgtgccacgccaccttcaccatgcggctgctcagcccgatccgcgtgcccaactacaacctgatcatcatggacgaggcccacttcacggaccccgcctccatcgcggcccggggctacatcagcacccgcgtggagatgggcgaggccgccgggatcttcatgaccgccacgccgcccggctcccgggaccccttcccccagagcaacgcgcccatcatggacgaggagcgcgagatccccgagcggtcctggaacagcgggcacgagtgggtcacggacttcaagggcaagaccgtgtggttcgtgccctccatcaaggccgggaacgacatcgccgcctgcctgcgcaagaacggcaagaaggtcatccagctcagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctggccggcccgatgcccgtgacgcactccagcgccgcccagcggcgcgggcgggtcggccgcaaccccaagaacgagaacgaccagtacatctacatgggggagcccctcgagaacgacgaggactgcgcgcactggaaggaggccaagatgctgctggacaacatcaacaccccggagggcatcatcccctccatgttcgagcccgagcgcgagaaggtggacgccatcgacggcgagtaccggctccgcggggaggcccggaagaccttcgtggacctgatgcgccggggcgacctgccggtctggctcgcctaccgcgtggcggccgaggggatcaactacgccgaccggcgctggtgcttcgacggcgtgaagaacaaccagatcctggaggagaacgtcgaggtggagatctggaccaaggagggggagcggaagaagctgaagccccgctggctcgacgcccggatctacagcgaccccctggccctgaaggagttcaaggagttcgcggccggccgcaagtccctcacgctgaacctgatcaccgagatgggccggctccccaccttcatgacccagaaggcccgcaacgccctggacaacctggcggtgctccacacggccgaggccgggggccgggcctacaaccacgccctgagcgagctgccggagaccctcgagaccctgctgctcctgaccctgctcgcgacggtcaccgggggcatcttcctgttcctgatgtccggcaaggggatcggcaagatgaccctcgggatgtgctgcatcatcaccgccagcgtgctgctgtggtacgcccagatccagccccactggatcgccgcctccatcatcctcgagttcttcctgatcgtgctgctcatccccgagcccgagaagcagcgcaccccgcaggacaaccagctgacgtacgtcgtgatcgcgatcctgaccgtggtcgccgccaccatggccaacgagatgggcttcctcgagaagaccaagaaggacttcgggctgggcggcatcgccacgcagcagcccgagagcaacatcctggacatcgacctccggcccgcgagcgcctggaccctgtacgccgtggccaccaccttcatcacgcccatgctgcgccactccatcgagaacagctccgtgaacgtcagcctcaccgccatcgcgaaccaggccaccgtgctgatggggctgggcaaggggtggccgctctccaagatggacatcggcgtgcccctgctggccatcgggtgctacagccaggtcaaccccatcaccctcacggccgcgctgctgctcctggtggcccactacgccatcatcggccccggcctgcaggccaaggccacccgggaggcgcagaagcgcgccgccgccgggatcatgaagaacccgaccgtggacggcatcaccgtcatcgacctcgaccccatcccctacgaccccaagttcgagaagcagctgggccaggtgatgctgctcgtgctgtgcgtcacccaggtgctgatgatgcggaccacctgggccctctgcgaggcgctgaccctggccacgggcccgatctccaccctctgggaggggaaccccggccgcttctggaacaccaccatcgccgtgagcatggccaacatcttccgcggctcctacctggccggggcgggcctcctcttcagcatcatgaagaacacggccaacacccggcgcgggaccggcaacaccggcgagacgctgggggagaagtggaagaaccggctgaacgccctcggcaagtccgagttccagatctacaagaagtccgggatccaggaggtcgaccgcaccctggccaaggagggcatcaagcgcggggagaccgaccaccacgcggtgtcccgcggcagcgccaagctgcggtggttcgtggagcgcaacctcgtcacccccgagggcaaggtgatggacctggggtgcggccgcggcgggtggtcctactactgcggcgggctgaagaacgtgaaggaggtcaaggggctcacgaagggcgggcccgggcacgaggagccgatccccatgagcacctacggctggaacctggtgcgcctgcagtccggggtggacgtcttcttcacgccgcccgagaagtgcgacaccctcctgtgcgacatcggcgagagctccccgaaccccacggtggaggccggccggaccctgcgcgtgctcaacctggtcgagaactggctgaacaacaacacccagttctgcatcaaggtgctcaacccctacatgccgagcgtgatcgagaagatggaggccctgcagcggaagtacgggggcgccctggtccgcaaccccctgagccggaactccacccacgagatgtactgggtgagcaacgcgtccgggaacatcgtgagctccgtcaacatgatcagccgcatgctcatcaaccggttcaccatgcgccacaagaaggccacgtacgagcccgacgtggacctgggctccgggacccggaacatcggcatcgagagcgagacccccaacctggacatcatcggcaagcgcatcgagaagatcaagcaggagcacgagacctcctggcactacgaccaggaccacccgtacaagacgtgggcctaccacgggagctacgagaccaagcagaccggctccgccagctccatggtgaacggggtcgtgcgcctcctgaccaagccctgggacgtcatccccatggtgacgcagatggccatgaccgacaccacccccttcggccagcagcgggtgttcaaggagaaggtcgacacgcgcacccaggagccgaaggagggcaccaagaagctgatgaagatcaccgcggagtggctctggaaggagctggggaagaagaagacgccccggatgtgcacccgcgaggagttcacccggaaggtgcgcagcaacgccgccctgggcgccatcttcaccgacgagaacaagtggaagtccgcccgggaggcggtggaggacagcgggttctgggagctcgtcgacaaggagcgcaacctgcacctggagggcaagtgcgagacgtgcgtgtacaacatgatggggaagcgggagaagaagctcggcgagttcggcaaggccaaggggtcccgcgccatctggtacatgtggctgggcgcccggttcctggagttcgaggcgctcgggttcctgaacgaggaccactggttcagccgcgagaactccctgagcggcgtggagggggagggcctccacaagctgggctacatcctgcgggacgtcagcaagaaggagggcggggccatgtacgccgacgacaccgccgggtgggacacccgcatcaccctcgaggacctgaagaacgaggagatggtgacgaaccacatggagggcgagcacaagaagctggccgaggcgatcttcaagctcacctaccagaacaaggtggtccgggtgcagcgccccacgccccgggggaccgtgatggacatcatctcccgccgggaccagcgcggcagcggccaggtcgtgacgtacgggctgaacaccttcaccaacatggaggcccagctgatccggcagatggagggcgagggggtgttcaagtccatccagcagctcaccgccacggaggagatcgccgtcaagaactggctggcccgcgtgggccgcgagcggctgagccgcatggcgatctccggcgacgactgcgtggtcaagccgctcgacgaccggttcgccagcgccctgaccgccctgaacgacatggggaaggtgcgcaaggacatccagcagtgggagccctcccggggctggaacgactggacccaggtgcccttctgcagccaccacttccacgagctcatcatgaaggacgggcgcgtcctggtggtgccctgccggaaccaggacgagctgatcggccgcgcccggatctcccagggggcgggctggagcctccgcgagaccgcctgcctgggcaagtcctacgcccagatgtggagcctgatgtacttccaccggcgcgacctccggctggccgccaacgcgatctgctccgccgtcccgagccactgggtgcccacgtcccgcaccacctggagcatccacgccacccacgagtggatgaccacggaggacatgctggccgtgtggaaccgggtctggatccaggagaacccctggatcgaggacaagacccccgtggagtcctgggaggagatcccgtacctcgggaagcgcgaggaccagtggtgcggcagcctgatcgggctgaccagccgggcgacctgggccaagaacatccagacggccatcaaccaggtgcgctccctcatcggcaacgaggagtacaccgactacatgcccagcatgaagcggttccgccgcgaggaggaggaggccggggtcctgtggtga

SEQ ID NO: 9788 - RNA, 9876 nt, synthetic construct
  misc_feature 1..9876: note = derived and/or modified CDS sequence (opt1) from DENV-2__DQ645554__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcttctggaacaccaccatcgccgtgagcatggccaacatcttccgcggctcctacctggccggggcgggcctcctgttcagcatcatgaagaacacggccaacacccggcgcgggaccggcaacaccggcgagacgctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacccccgagggcaaggtgatggacctggggtgcggccgcggcgggtggtcctactactgcggcgggctcaagaacgtgaaggaggtcaaggggctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagctcccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtggaggacagcgggttctgggagctggtcgacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggggccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtggtccgggtgcagcgccccacgccccgggggaccgtgatggacatcatctcccgccgggaccagcgcggcagcggccaggtcgtgacgtacgggctgaacaccttcaccaacatggaggcccagctcatccggcagatggagggcgagggggtgttcaagtccatccagcagctgaccgccacggaggagatcgccgtcaagaactggctggcccgcgtgggccgcgagcggctcagccgcatggcgatctccggcgacgactgcgtggtcaagcccctggacgaccggttcgccagcgccctgaccgccctcaacgacatggggaagatccgcaaggacatccagcagtgggagccgtcccggggctggaacgactggacccaggtgcccttctgcagccaccacttccacgagctgatcatgaaggacgggcgcgtgctggtcgtgccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtgcccagccactgggtcccgacgtcccgcaccacctggagcatccacgccacccacgagtggatgaccacggaggacatgctcaccgtgtggaaccgggtgtggatccaggagaacccctggatcgaggacaagacccccgtcgagtcctgggaggagatcccctacctggggaagcgcgaggaccagtggtgcggcagcctgatcgggctcaccagccgggccacgtgggcgaagaacatccagaccgccatcaaccaggtgcgctccctgatcggcaacgaggagtacaccgactacatgccgagcatgaagcggttccgccgcgaggaggaggaggccggggtgctgtggtga

SEQ ID NO: 9789 - RNA, 9876 nt, synthetic construct
  misc_feature 1..9876: note = derived and/or modified CDS sequence (opt1) from DENV-2__DQ645555__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagccagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcttctggaacaccaccatcgccgtgagcatggccaacatcttccgcggctcctacctggccggggcgggcctcctgttcagcatcatgaagaacacggccaacacccggcgcgggaccggcaacaccggcgagacgctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacccccgagggcaaggtgatggacctggggtgcggccgcggcgggtggtcctactactgcggcgggctcaagaacgtgaaggaggtcaaggggctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagctcccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtggaggacagcgggttctgggagctggtcgacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggggccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtggtccgggtgcagcgccccacgccccgggggaccgtgatggacatcatctcccgccgggaccagcgcggcagcggccaggtcgtgacgtacgggctgaacaccttcaccaacatggaggcccagctcatccggcagatggagggcgagggggtgttcaagtccatccagcagctgaccgccacggaggagatcgccgtcaagaactggctggcccgcgtgggccgcgagcggctcagccgcatggcgatctccggcgacgactgcgtggtcaagcccctggacgaccggttcgccagcgccctgaccgccctcaacgacatggggaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtccccagccactgggtgccgacgtcccgcaccacctggagcatccacgccacccacgagtggatgaccacggaggacatgctcaccgtgtggaaccgggtctggatccaggagaacccctggatcgaggacaagacccccgtggagtcctgggaggagatcccctacctggggaagcgcgaggaccagtggtgcggcagcctgatcgggctcaccagccgggccacgtgggcgaagaacatccagaccgccatcaaccaggtgcgctccctgatcggcaacgaggagtacaccgactacatgccgagcatgaagcggttccgccgcgaggaggaggaggccggggtcctgtggtga

SEQ ID NO: 9790 - RNA, 9876 nt, synthetic construct
  misc_feature 1..9876: note = derived and/or modified CDS sequence (opt1) from DENV-2__DQ645556__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacccggaccgagacctggatgtccagcgagggcgcctggaagcacgcccagcggatcgagacctgggtgctccgccaccccgggttcaccatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcaccccgccaccctgcgcaagtactgcatcgaggccaagctcaccaacacgaccaccgcgagccggtgcccgacccagggggagccctccctgaacgaggagcaggacaagcgcttcgtgtgcaagcacagcatggtggaccggggctggggcaacgggtgcggcctgttcgggaagggcgggatcgtcacgtgcgccatgttcacgtgcaagaagaacatggagggcaaggtggtgcagcccgagaacctcgagtacaccatcgtcatcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagaccctggtgacgttcaagaacccccacgccaagaagcaggacgtggtcgtgctgggcagccaggagggggccatgcacaccgccctcaccggcgccaccgagatccagatgagctccgggaacctgctgttcacgggccacctcaagtgccgcctgcggatggacaagctgcagctcaagggcatgagctactccatgtgcaccgggaagttcaaggtggtcaaggagatcgcggagacccagcacggcaccatcgtgatccgcgtgcagtacgagggggacggcagcccctgcaagatccccttcgagatcatggacctggagaagcggcacgtcctgggccgcctcatcacggtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccaccatgcgcggcgccaagcggatggccatcctcggcgacacggcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacctggatcggcatgaacagccgctccacgagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacctggacggagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgaccatcatgacgggggacatcaagggcatcatgcaggccgggaagcggagcctccgcccgcagcccaccgagctgaagtactcctggaaggcgtggggcaaggccaagatgctgagcaccgagctccacaaccacaccttcctgatcgacggccccgagacggccgagtgcccgaacaccaaccgggcctggaactccctggaggtggaggactacgggttcggcgtgttcaccaccaacatctggctcaagctgaaggagcgccaggacgtcttctgcgacagcaagctgatgtccgccgcgatcaaggacaaccgggccgtgcacgccgacatggggtactggatcgagagcgccctcaacgacacgtggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcaccacggtggtcgtgaccgaggactgcgggaaccggggccccagcctgcgcaccaccacggcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcaccgccggccacgggcagatcgacaacttcagcctcggcgtgctgggcatggcgctgttcctcgaggagatgctgcggacgcgcgtggggaccaagcacgccatcctgctcgtcgccgtgtccttcgtgaccctgatcaccggcaacatgagcttccgggacctggggcgcgtcatggtgatggtgggcgccacgatgaccgacgacatcgggatgggcgtcacctacctcgccctgctggcggccttcaaggtgcgccccaccttcgccgccggcctcctgctgcggaagctcacgtccaaggagctgatgatgaccaccatcgggatcgtcctgctcagccagtccaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcaccatcctcgcggtggtgtccgtcagccccctgctgctcacgtccagccagcagaaggccgactggatccccctggccctgaccatcaaggggctcaaccccaccgccatcttcctgaccacgctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcaccgtgtgctacgtgctgacggggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgaccatcctcatccgcacgggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacccggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagacgaagcccgggctgttcaagaccaacaccggcaccatcggggccgtgagcctggacttctcccccggcacgagcggctcccccatcgtcgacaagaaggggaaggtggtgggcctctacgggaacggcgtcgtgacccgcagcggcacctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtccgcgaggcgatcaagcgggggctccgcaccctgatcctggccccgacccgggtggtggccgccgagatggaggaggccctccgcggcctgcccatccgctaccagacgcccgcgatccgggccgagcacaccgggcgcgagatcgtcgacctgatgtgccacgccaccttcaccatgcggctcctgagccccatccgcgtgccgaactacaacctgatcatcatggacgaggcccacttcacggaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggaccaaggagggggagcggaagaagctcaagccgcgctggctggacgcccggatctacagcgaccccctggccctcaaggagttcaaggagttcgcggccggccgcaagtccctgacgctgaacctcatcaccgagatgggccggctgcccaccttcatgacccagaaggcccgcaacgccctggacaacctcgcggtgctgcacacggccgaggccgggggccgggcctacaaccacgccctgagcgagctccccgagaccctggagaccctgctcctgctgaccctcctggcgacggtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacttcgggctgggcggcatcgccacgcagcagccggagagcaacatcctcgacatcgacctgcggcccgcgagcgcctggaccctgtacgccgtggccaccaccttcatcacgcccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcaccctgacggccgcgctgctcctgctggtggcccactacgccatcatcggccccggcctccaggccaaggccacccgggaggcgcagaagcgcgccgccgccgggatcatgaagaaccccaccgtggacggcatcaccgtcatcgacctggacccgatcccctacgaccccaagttcgagaagcagctgggccaggtgatgctcctggtgctgtgcgtcacccaggtgctcatgatgcggaccacctgggccctgtgcgaggcgctgaccctcgccacgggccccatctccaccctgtgggaggggaacccgggccgcttctggaacaccaccatcgccgtgagcatggccaacatcttccgcggctcctacctggccggggcgggcctcctgttcagcatcatgaagaacacggccaacacccggcgcgggaccggcaacaccggcgagacgctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacccccgagggcaaggtgatggacctggggtgcggccgcggcgggtggtcctactactgcggcgggctcaagaacgtgaaggaggtcaaggggctgacgaagggcgggcccgggcacgaggagcccatcccgatgagcacctacggctggaacctggtgcgcctccagtccggggtggacgtcttcttcacgccgcccgagaagtgcgacaccctgctgtgcgacatcggcgagagctcccccaacccgacggtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcaccatgcgccacaagaaggccacgtacgagcccgacgtggacctgggctccgggacccggaacatcggcatcgagagcgagacccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtggaggacagcgggttctgggagctggtcgacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggggccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtggtccgggtgcagcgccccacgccccgggggaccgtgatggacatcatctcccgccgggaccagcgcggcagcggccaggtcgtgacgtacgggctgaacaccttcaccaacatggaggcccagctcatccggcagatggagggcgagggggtgttcaagaacatccagcagctgaccgccacggaggagatcgccgtcaagaactggctggcccgcgtgggccgcgagcggctctcccgcatggcgatcagcggcgacgactgcgtggtcaagcccctggacgaccggttcgcctccgccctgaccgccctcaacgacatggggaaggtgcgcaaggacgtgcagcagtgggagccgagccggggctggaacgactggacccaggtccccttctgctcccaccacttccacgagctgatcatgaaggacgggcgcgtgctggtggtcccctgccggaaccaggacgagctcatcggccgcgcccggatcagccagggggcgggctggtccctgcgcgagaccgcctgcctgggcaagagctacgcccagatgtggtccctcatgtacttccaccggcgcgacctgcggctggccgccaacgcgatctgcagcgccgtgccctcccactgggtgccgacgagccgcaccacctggtccatccacgccacccacgagtggatgaccacggaggacatgctcaccgtctggaaccgggtgtggatccaggagaacccctggatcgaggacaagacccccgtggagagctgggaggagatcccctacctggggaagcgcgaggaccagtggtgcggctccctgatcgggctcaccagccgggccacgtgggcgaagaacatccagaccgccatcaaccaggtccgcagcctgatcggcaacgaggagtacaccgactacatgccgtccatgaagcggttccgccgcgaggaggaggaggccggggtgctgtggtga

SEQ ID NO: 9791 - RNA, 9876 nt, synthetic construct
  misc_feature 1..9876: note = derived and/or modified CDS sequence (opt1) from DENV-2__AF204178__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaagaccggggacggcgtgaacatgtgcaccctcatggcgatggaccccggggagctgtgcgaggacaccatcacctacaagtgccccctgctcaagcagaacgagcccgaggacatcgactggtggtgcaacagcacctccacctgggtgacctacgggacctgcaccaccaccggcgagcaccggcgggagaagcgcagcgtcgccctggtgccgcacgtggggatgggcctggagacccggaccgagacctggatgtccagcgagggggcctggaagcacgcccagcggatcgagacgtggatcctccggcaccccggcttcaccatgatggccgcgatcctggcctacaccatcgggaccacgcacttccagcgcgccctgatcttcatcctcctgaccgccgtcgcgccctccatgaccatgcggtgcatcggcatcagcaaccgcgacttcgtggagggcgtgtccgggggcagctgggtcgacatcgtgctggagcacgggtcctgcgtgaccacgatggccaagaacaagcccaccctcgacttcgagctgatcaagaccgaggccaagcagccggccaccctgcggaagtactgcatcgaggccaagctcacgaacaccaccaccgacagccgctgccccacgcagggcgagccctccctgaacgaggagcaggacaagcggttcgtctgcaagcacagcatggtggaccgcggctgggggaacggctgcgggctgttcggcaagggcgggatcgtgaccttcgcgatgttcacgtgcaagaagaacatgaagggcaaggtcgtgcagcccgagaacctcgagtacaccatcgtgatcacgccgcactccggggaggagcacgccgtcggcaacgacaccgggaagcacggcaaggagatcaagatcacgccccagagctccatcaccgaggccgagctgaccgggtacggcacggtgaccatgaagtgcagcccccggaccggcctggacttcaacgagatggtgctcctgcagatggagaacaaggcctggctggtccaccgccagtggttcctcgacctgcccctgccgtggctccccggggccgacacccagggctccaactggatccagaaggagacgctggtgaccttcaagaacccccacgcgaagaagcaggacgtggtcgtgctggggagccaggagggcgccatgcacaccgccctcaccggggccacggagatccagatgagctccggcaacctgctgttcaccggccacctcaagtgccggctgcgcatggacaagctgcagctcaaggggatgagctactccatgtgcaccggcaagttcaaggtcgtgaaggagatcgccgagacccagcacgggacgatcgtgatccgggtccagtacgagggcgacggcagcccctgcaagatcccgttcgagatcatggacctggagaagcgccacgtgctggggcggctcatcaccgtgaaccccatcgtcaccgagaaggactcccccgtgaacatcgaggcggagcccccgttcggcgacagctacatcatcatcggggtggagcccggccagctgaagctgaactggttcaagaaggggtccagcatcggccagatgttcgagaccacgatgcgcggcgccaagcgcatggccatcctcggggacaccgcctgggacttcggctccctcggcggggtcttcaccagcatcgggaaggccctgcaccaggtgttcggggcgatctacggcgccgccttctccggggtgagctggaccatgaagatcctcatcggcgtcatcatcacgtggatcgggatgaactcccggagcacctccctgagcgtgtccctggtgctggtcggcgtggtgaccctctacctgggggtcatggtgcaggccgacagcggctgcgtggtctcctggaagaacaaggagctgaagtgcggcagcgggatcttcatcaccgacgacgtgcacacgtggaccgagcagtacaagttccagcccgagagcccctccaagctcgcgagcgccatccagaaggcccacgaggagggcatctgcgggatccgctccgtgacccggctggagaacctgatgtggaagcagatcaccccggagctcaaccacatcctgagcgagaacgaggtcaagctgacgatcatgaccggcgacatcaaggggatcatgcaggccggcaagcgctccctccggccccagcccaccgagctgaagtacagctggaagacctggggcaaggccaagatgctgtccacggagagccacaaccagaccttcctcatcgacgggccggagaccgcggagtgccccaacaccaaccgcgcctggaactccctggaggtggaggactacggcttcggggtgttcacgaccaacatctggctgaagctccgggagaagcaggacgtcttctgcgacagcaagctgatgtccgccgtgatcaaggacaaccgcgccgcccacgcggacatgggctactggatcgagagcgccctgaacgacacctggaagatcgagaaggcctccttcatcgaggtcaagagctgccactggcccaagtcccacaccctctggagcaacggcgtgctggagtccgagatgatcatccccaagaacttcgccgggccggtgagccagcacaactaccggcccggctaccacacccagacggccgggccctggcacctgggcaagctcgagatggacttcgacttctgcgaggggaccaccgtggtcgtgaccgaggactgcggcaaccgcggccccagcctgcggacgaccaccgcgtccgggaagctgatcaccgagtggtgctgccgcagctgcacgctcccgcccctgcggtaccgcggcgaggacgggtgctggtacggcatggagatccggcccctgaaggagaaggaggagaacctcgtgaactccctggtcaccgccgggcacggccagatcgacaacttcagcctgggcgtgctcgggatggccctgttcctggaggagatgctccgcacccgggtgggcaccaagcacgccatcctgctggtcgcggtgtccttcgtgacgctcatcaccgggaacatgagcttccgcgacctgggccgggtcatggtgatggtgggggccaccatgaccgacgacatcggcatgggcgtcacgtacctggccctcctggccgccttcaaggtgcgccccaccttcgcggccgggctgctcctgcgcaagctgacctccaaggagctcatgatgaccacgatcggcatcgtgctgctgagccagtccaccatcccggagaccatcctcgagctgaccgacgccctggccctcgggatgatggtcctgaagatggtgcggaagatggagaagtaccagctggccgtgacgatcatggcgatcctctgcgtccccaacgccgtgatcctgcagaacgcctggaaggtcagctgcaccatcctggccgtggtgtccgtcagccccctcttcatcacctccagccagcagaaggccgactggatccccctggcgctgaccatcaagggcctcaacccgacggccatcttcctgaccaccctgtcccgcaccaacaagaagcggagctggcccctcaacgaggccatcatggccgtgggcatggtgtccatcctggcgagctccctgctcaagaacgacatccccatgacggggcccctggtcgccggcgggctgctcaccgtgtgctacgtgctgaccggccgcagcgccgacctggagctcgagcgggccgccgacgtcaagtgggaggaccaggcggagatcagcgggtccagcccgatcctgtccatcaccatcagcgaggacggctccatgagcatcaagaacgaggaggaggagcagatcctgacgatcctcatccgcaccggcctgctggtgatctccgggctgttccccgtgagcatccccatcaccgccgccgcctggtacctgtgggaggtcaagaagcagcgggccggcgtgctgtgggacgtgccctccccgccgcccgtcgggaaggcggagctcgaggacggcgcctaccgcatcaagcagaaggggatcctgggctacagccagatcggcgccggggtgtacaaggagggcaccttccacaccatgtggcacgtgacgcgcggggccgtcctgatgcacaagggcaagcgcatcgagccgtcctgggccgacgtgaagaaggacctcatcagctacgggggcggctggaagctggagggggagtggaaggagggcgaggaggtgcaggtcctggcgctcgagcccgggaagaacccccgggccgtgcagaccaagcccggcctgttcaagaccaacgccgggaccatcggcgccgtgtccctggacttcagcccgggcacgtccgggagccccatcatcgacaagaagggcaaggtcgtggggctctacggcaacggcgtggtcacccgctccggggcctacgtgagcgcgatcgcccagaccgagaagtccatcgaggacaaccccgagatcgaggacgacatcttccggaagcgcaagctgaccatcatggacctgcaccccggcgccgggaagacgaagcggtacctcccggccatcgtgcgcgaggcgatcaagcggggcctgcgcaccctgatcctggcccccacccgggtcgtggccgccgagatggaggaggccctccgcgggctgcccatccggtaccagacccccgcgatccgcgccgagcacacgggccgcgagatcgtggacctgatgtgccacgccaccttcaccatgcggctcctgagcccggtccgcgtgcccaactacaacctgatcatcatggacgaggcccacttcaccgaccccgccagcatcgcggcccggggctacatctccacgcgcgtggagatgggggaggccgccggcatcttcatgaccgccacgccgcccgggagccgggaccccttcccccagtccaacgcgcccatcatggacgaggagcgcgagatccccgagcggagctggtccagcggccacgagtgggtcaccgacttcaaggggaagacggtgtggttcgtgccctccatcaaggccggcaacgacatcgccgcctgcctccgcaagaacggcaagaaggtcatccagctgagccggaagaccttcgactccgagtacgtgaagacccgcaccaacgactgggacttcgtggtcacgaccgacatcagcgagatgggggcgaacttcaaggccgagcgggtgatcgacccccgccggtgcatgaagcccgtgatcctgaccgacggcgaggagcgcgtcatcctcgccgggccgatgcccgtgacccactccagcgccgcccagcggcgcggccggatcgggcgcaaccccaagaacgagaacgaccagtacatctacatgggcgagcccctggagaacgacgaggactgcgcgcactggaaggaggccaagatgctgctcgacaacatcaacacgccggagggcatcatcccctccatgttcgagcccgagcgggagaaggtggacgccatcgacggggagtaccgcctgcgcggcgaggcccggaagaccttcgtcgacctgatgcgccgcggggacctcccggtgtggctggcctaccgcgtggcggccgagggcatcaactacgccgaccggcgctggtgcttcgacgggatcaagaacaaccagatcctggaggagaacgtcgaggtggagatctggaccaaggagggcgagcggaagaagctcaagccccgctggctggacgccaagatctacagcgaccccctggccctcaaggagttcaaggagttcgcggccggccggaagtccctgaccctgaacctcatcacggagatggggcgcctgcccaccttcatgacccagaaggcccgggacgccctggacaacctcgcggtcctgcacaccgccgaggccggcgggcgcgcctacaaccacgccctgagcgagctcccggagacgctggagaccctgctcctgctgaccctcctggcgaccgtgacgggcggcatcttcctgttcctcatgtccgggcggggcatcgggaagatgaccctgggcatgtgctgcatcatcaccgccagcatcctgctctggtacgcccagatccagccccactggatcgccgcctccatcatcctggagttcttcctgatcgtgctcctgatccccgagcccgagaagcagcgcaccccgcaggacaaccagctgacctacgtcgtgatcgcgatcctcacggtggtcgccgccaccatggccaacgagatggggttcctggagaagaccaagaaggacctgggcctcggcagcatcaccacgcagcagcccgagagcaacatcctggacatcgacctgcggcccgcctccgcgtggaccctctacgccgtggccaccaccttcgtgacgcccatgctgcgccacagcatcgagaactccagcgtcaacgtgtccctgaccgccatcgccaaccaggcgaccgtgctcatggggctgggcaaggggtggccgctgagcaagatggacatcggcgtccccctcctggccatcgggtgctactcccaggtgaaccccatcaccctgacggccgccctcttcctgctggtggcgcactacgccatcatcggccccggcctccaggccaaggccacccgggaggcccagaagcgcgcggccgccgggatcatgaagaacccgaccgtcgacggcatcaccgtgatcgacctggaccccatcccctacgaccccaagttcgagaagcagctgggccaggtgatgctcctggtcctgtgcgtgacccaggtgctcatgatgcggaccacctgggccctgtgcgaggccctgaccctcgcgacgggcccgatcagcaccctgtgggaggggaaccccggccgcttctggaacaccaccatcgccgtctccatggccaacatcttccggggcagctacctggccggggccggcctcctgttctccatcatgaagaacacgaccaacacccgccgcgggaccggcaacatcggcgagacgctgggggagaagtggaagatccggctcaacgcgctgggcaagagcgagttccagatctacaagaagtccgggatccaggaggtggaccgcaccctggccaaggagggcatcaagcgcggggagaccgaccaccacgccgtgagccgcggctccgccaagctccggtggttcgtcgagcgcaacatggtgacccccgagggcaaggtggtcgacctggggtgcggccgcggcgggtggagctactactgcggcgggctgaagaacgtgcgcgaggtgaaggggctcacgaagggcggccccgggcacgaggagccgatccccatgtccacctacggctggaacctggtccggctgcagagcggggtggacgtgttcttcacgccgcccgagaagtgcgacaccctcctgtgcgacatcggcgagtccagcccgaaccccacggtcgaggcgggccgcaccctgcgggtgctcaacctggtggagaactggctgaacaacaacacccagttctgcatcaaggtcctcaacccctacatgccgagcgtgatcgagaagatggagaccctgcagcgcaagtacgggggcgccctggtggggaaccccctctcccggaacagcacccacgagatgtactgggtctccaacgccagcggcaacatcgtgtccagcgtgaacatgatctcccgcatgctgatcaaccggttcacgatgcgccacaagaaggccacctacgagcccgacgtcgacctggggagcggcacccggaacatcggcatcgagtccgagatccccaacctggacatcatcgggaagcgcatcgagaagatcaagcaggagcacgagaccagctggcactacgaccaggaccacccgtacaagacgtgggcctaccacggctcctacgagaccaagcagaccgggagcgcgtccagcatggtgaacggcgtggtccggctcctgaccaagccctgggacgtggtgcccatggtcacgcagatggccatgaccgacaccacccccttcggccagcagcgcgtgttcaaggagaaggtggacacgcgcacccaggagccgaaggaggggaccaagaagctgatgaagatcaccgccgagtggctctggaaggagctgggcaagaagaagacgccccggatgtgcacccgcgaggagttcacccggaaggtccgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacgtgcgtgtacaacatgatggggaagcgcgagaagaagctcggcgagttcggcaaggccaaggggagccgggccatctggtacatgtggctgggcgcgcgcttcctggagttcgaggccctcgggttcctgaacgaggaccactggttctcccgggagaacagcctgagcggcgtggagggggagggcctctacaagctgggctacatcctgcgcgacgtctccaagaaggagggcggcgccatgtacgccgacgacaccgcggggtgggacacccggatcaccctcgaggacctgaagaacgaggagatggtgacgaaccacatggagggcgagcacaagaagctggccgaggccatcttcaagctcacctaccagaacaaggtggtccgcgtgcagcggcccacgccccgggggaccgtgatggacatcatcagccggcgcgaccagcggggctccggccaggtcgggacgtacggcctgaacaccttcaccaacatggaggcccagctgatccgccagatggagggggagggcgtgttcaagagcatccagcacctcaccgtgacggaggagatcgccgtccagaactggctggcgcgggtgcgccgcgagcggctgtcccgcatggccatcagcggcgacgactgcgtggtcaagccgctcgacgaccggttcgcctccgccctgaccgccctgaacgacatggggaaggtgcgcaaggacatccagcagtgggagcccagccggggctggaacgactggacccaggtgcccttctgctcccaccacttccacgagctcatcatgaaggacgggcgcgtcctggtggtgccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtcccgtcccactgggtgcccacgagccgcaccacctggtccatccacgccaagcacgagtggatgaccaccgaggacatgctgacggtgtggaaccgggtctggatccaggagaacccctggatggaggacaagacccccgtggagagctgggaggagatcccgtacctcgggaagcgcgaggaccagtggtgcggcagcctgatcgggctgacctcccgggccacctgggcgaagaacatccagacggccatcaaccaggtgcgcagcctcatcggcaacgaggagtacaccgactacatgccctccatgaagcggttccgccgcgaggaggaggaggccggggtcctgtggtga

SEQ ID NO: 9792 - RNA, 9876 nt, synthetic construct
  misc_feature 1..9876: note = derived and/or modified CDS sequence (opt1) from DENV-2__AF204177__SS-prME
  source 1..9876: mol_type = other RNA
accgcgggcatgatcatcatgctgatccccaccgtgatggccttccacctcaccacccggaacggggagccccacatgatcgtcagccggcaggagaagggcaagagcctgctgttcaagaccggggacggcgtgaacatgtgcaccctcatggcgatggacctgggggagctgtgcgaggacaccatcacctacaagtgccccctcctgcgccagaacgagcccgaggacatcgactgctggtgcaacagcaccagcacctgggtgacctacgggacctgcaccaccaccggcgagcaccggcgcgagaagcggagcgtcgccctggtgccccacgtggggatgggcctcgagacccgcaccgagacctggatgtccagcgagggggcctggaagcacgcccagcggatcgagacgtggatcctgcgccaccccggcttcaccatcatggccgcgatcctggcctacaccatcgggaccacgcacttccagcgggccctcatcttcatcctgctgaccgccgtcgcgccctccatgaccatgcgctgcatcggcatcagcaaccgggacttcgtggagggcgtgtccgggggcagctgggtcgacatcgtgctcgagcacgggtcctgcgtgaccacgatggccaagaacaagcccaccctggacctggagctcatcaagaccgaggccaagcagagcgccaccctgcgcaagtactgcatcgaggccaagctgacgaacaccaccaccgagtcccggtgccccacgcagggcgagcccagcctcaacgaggagcaggacaagcgcttcgtctgcaagcactccatggtggaccggggctgggggaacggctgcgggctgttcggcaagggcgggatcgtgacctgcgcgatgttcacgtgcaagaagaacatgaagggcaaggtcgtgcagcccgagaacctggagtacaccatcgtgatcacgccccacagcggggaggagcacgccgtcggcaacgacaccgggaagcacggcaaggagatcaagatcacgccccagtccagcatcaccgaggccgagctcaccgggtacggcacggtgaccatggagtgctccccgcgcaccggcctggacttcaacgagatggtgctgctccagatggagaacaaggcctggctggtccaccggcagtggttcctggacctccccctgccctggctgcccggggccgacacccagggcagcaactggatccagaaggagacgctcgtgaccttcaagaacccgcacgcgaagaagcaggacgtggtcgtgctggggagccaggagggcgccatgcacaccgccctgaccggggccacggagatccagatgtccagcggcaacctcctgttcaccggccacctgaagtgccgcctccggatggacaagctgcagctgaaggggatgtcctacagcatgtgcaccggcaagttcaaggtcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaaccccatcgtcaccgagaaggacagcccggtgaacatcgaggcggagccgcccttcggcgactcctacatcatcatcggggtggagcccggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgactccggctgcgtggtcagctggaagaacaaggagctgaagtgcggcagcgggatcttcatcaccgacaacgtgcacacgtggaccgagcagtacaagttccagccggagtcccccagcaagctggcgtccgccatccagaaggcccacgaggagggcatctgcgggatccggagcgtgacccgcctcgagaacctgatgtggaagcagatcacccccgagctgaaccacatcctctccgagaacgaggtcaagctgacgatcatgaccggcgacatcaaggggatcatgcaggccggcaagcggagcctgcgcccccagccgaccgagctcaagtactcctggaagacctggggcaaggccaagatgctgagcacggagtcccacaaccagaccttcctgatcgacgggcccgagaccgcggagtgccccaacaccaaccgggcctggaacagcctcgaggtggaggactacggcttcggggtgttcacgaccaacatctggctgaagctgcgcgagaagcaggacgtcttctgcgactccaagctcatgagcgccgccatcaaggacaaccgggccgtgcacgcggacatgggctactggatcgagtccgccctgaacgacacctggaagatcgagaaggccagcttcatcgaggtgaagtcctgccactggcccaagagccacaccctgtggtccaacgaggtcctcgagagcgagatgatcatccccaagaacttcgccggccccgtgagccagcacaactaccgccccgggtaccacacccagacggccggcccgtggcacctggggaagctggagatggacttcgacttctgcgagggcaccaccgtggtcgtgaccgaggactgcgggaaccggggcccctccctccgcacgaccaccgcgagcggcaagctgatcaccgagtgctgctgccggtcctgcacgctgccgcccctccgctaccgcggggaggacggctgctggtacgggatggagatccgcccgctgaaggagaaggaggagaacctggtgaacagcctcgtcaccgccggccacgggcagatcgacaacttctccctgggcgtgctgggcatggccctcttcctggaggagatgctgcggacccgcgtggggaccaagcacgccatcctcctggtcgcggtgagcttcgtgacgctgatcaccggcaacatgtccttccgggacctcgggcgcgtcatggtgatggtgggcgccaccatgaccgacgacatcgggatgggcgtcacgtacctggccctgctcgccgccttcaaggtgcgccccaccttcgcggccggcctgctgctccggaagctgaccagcaaggagctgatgatgaccacgatcgggatcgtgctcctgtcccagagcaccatccccgagaccatcctggagctcaccgacgccctggccctgggcatgatggtcctcaagatggtgcgcaagatggagaagtaccagctggccgtgacgatcatggcgatcctgtgcgtccccaacgccgtgatcctccagaacgcctggaaggtctcctgcaccatcctggccgtggtgagcgtctccccgctgttcctcaccagctcccagcagaaggccgactggatccccctggcgctgaccatcaaggggctcaaccccacggccatcttcctgaccaccctgagcaagaccaacaagaagcggtcctggcccctcaacgaggccatcatggccgtgggcatggtgagcatcctggcgtccagcctgctcaagaacgacatcccgatgacgggccccctggtcgccgggggcctgctcaccgtgtgctacgtgctgaccgggcgcagcgccgacctggagctcgagcgggccgccgacgtcaagtgggaggaccaggcggagatctccggcagctcccccatcctgagcatcaccatctccgaggacgggagcatgtccatcaagaacgaggaggaggagcagatcctgacgatcctcatccgcaccggcctgctggtgatcagcggcctcttccccgtgtccatcccgatcaccgccgccgcctggtacctgtgggaggtcaagaagcagcgggccggggtgctgtgggacgtgccctccccgccgcccgtcggcaaggcggagctcgaggacggggcctaccgcatcaagcagaagggcatcctggggtactcccagatcggcgccggcgtgtacaaggaggggaccttccacaccatgtggcacgtgacgcggggcgccgtcctgatgcacaaggggaagcgcatcgagcccagctgggccgacgtgaagaaggacctcatctcctacgcgggcgggtggaagctggagggcgagtggaaggagggcgaggaggtgcaggtcctggccctcgagcccgggaagaacccgcgggccgtgcagaccaagcccggcctgttcaagaccaacgccgggaccatcggcgccgtgagcctggacttctcccccgggacgagcggctcccccatcatcgacaagaagggcaaggtcgtggggctctacggcaacggggtggtcacccgcagcggcgcgtacgtgtccgccatcgcccagaccgagaagtccatcgaggacaacccggagatcgaggacgacatcttccggaagcgcaagctgaccatcatggacctgcaccccggcgccgggaagacgaagcggtacctgcccgcgatcgtgcgcgaggccatcaagcggggcctccgcaccctgatcctggcccccacccgggtcgtggccgccgagatggaggaggcgctccgcgggctgccgatccggtaccagacccccgccatccgcgccgagcacacgggccgcgagatcgtggacctgatgtgccacgccaccttcaccatgcggctcctgagccccgtccgcgtgcccaactacaacctgatcatcatggacgaggcccacttcaccgacccggcgtccatcgccgcccgggggtacatcagcacgcgcgtggagatgggcgaggccgccggcatcttcatgaccgcgacgccgcccgggtcccgggaccccttcccgcagagcaacgcccccatcatggacgaggagcgcgagatccccgagcggtcctggagctccggccacgagtgggtcaccgacttcaaggggaagacggtgtggttcgtgcccagcatcaaggccggcaacgacatcgccgcgtgcctccgcaagaacgggaagaaggtcatccagctgtcccggaagaccttcgacagcgagtacgtgaagacccgcaccaacgactgggacttcgtggtcacgaccgacatctccgagatgggcgccaacttcaaggccgagcgggtgatcgacccgcgccggtgcatgaagcccgtgatcctgaccgacggcgaggagcgcgtcatcctcgccgggcccatgcccgtgacccacagctccgccgcgcagcggcgcggccggatcgggcgcaacccgaagaacgagaacgaccagtacatctacatgggcgagcccctggagaacgacgaggactgcgcccactggaaggaggccaagatgctgctcgacaacatcaacacgcccgaggggatcatccccagcatgttcgagccggagcgggagaaggtggacgccatcgacggcgagtaccgcctgcgcggcgaggcccggaagaccttcgtcgacctgatgcgccgcggggacctccccgtgtggctggcgtaccgcgtggccgccgagggcatcaactacgccgaccggcgctggtgcttcgacgggatcaagaacaaccagatcctggaggagaacgtcgaggtggagatctggaccaaggagggcgagcggaagaagctcaagccccgctggctggacgcccggatctactccgacccgctggcgctcaaggagttcaaggagttcgccgccgggcgcaagagcctgaccctgaacctcatcacggagatgggccggctgcccaccttcatgacccagaaggcccgcgacgcgctggacaacctcgccgtcctgcacaccgccgaggccggcgggcgggcctacaaccacgcgctgtccgagctccccgagacgctggagaccctgctcctgctgaccctcctggccaccgtgacgggcgggatcttcctgttcctcatgagcggccgcggcatcgggaagatgaccctgggcatgtgctgcatcatcaccgcctccatcctgctctggtacgcccagatccagccccactggatcgccgcgagcatcatcctggagttcttcctgatcgtgctcctgatcccggagcccgagaagcagcggacgccccaggacaaccagctgacctacgtcgtgatcgccatcctcacggtggtcgccgccaccatggccaacgagatggggttcctggagaagaccaagaaggacctgggcctcgggagcatcaccacgcagcagcccgagtccaacatcctggacatcgacctgcgcccggcgagcgcctggaccctctacgccgtggccaccaccttcgtgacgcccatgctgcggcactccatcgagaacagctccgtcaacgtgagcctgaccgccatcgcgaaccaggccaccgtgctcatgggcctgggcaaggggtggcccctgtccaagatggacatcggcgtccccctcctggccatcgggtgctacagccaggtgaacccgatcaccctgacggccgccctcttcctgctggtggcccactacgccatcatcggccccgggctccaggccaaggccacccgcgaggcgcagaagcgggccgccgccggcatcatgaagaaccccaccgtcgacggcatcaccgtgatcgacctggaccccatcccgtacgaccccaagttcgagaagcagctgggccaggtgatgctcctggtcctgtgcgtgacccaggtgctcatgatgcgcaccacctgggccctgtgcgaggcgctgaccctcgccacgggccccatctccaccctgtgggaggggaaccccggccggttctggaacaccaccatcgccgtcagcatggccaacatcttccgcgggtcctacctggccggcgcgggcctcctgttcagcatcatgaagaacacgaccaacacccgccgggggaccggcaacatcggggagacgctgggcgagaagtggaagtcccgcctcaacgccctgggcaagagcgagttccagatctacaagaagtccgggatccaggaggtggaccggaccctggccaaggagggcatcaagcgcggggagaccgaccaccacgccgtgagccggggctccgcgaagctccgctggttcgtcgagcggaacatggtgaccccggaggggaaggtggtcgacctgggctgcggccgcgggggctggagctactactgcgggggcctgaagaacgtgcgggaggtgaaggggctcacgaagcgcggccccggccacgaggagcccatccccatgtccacctacgggtggaacctggtccggctgcagagcggcgtggacgtgttcttcaccccgcccgagaagtgcgacaccctcctgtgcgacatcggggagagctcccccaaccccacggtcgaggccggccgcaccctgcgggtgctcaacctggtggagaactggctgaacaacaacacccagttctgcatcaaggtcctcaacccgtacatgcccagcgtgatcgagaagatggaggccctgcagcgcaagtacgggggcgccctggtgcggaaccccctgtcccgcaacagcacccacgagatgtactgggtctccaacgccagcggcaacatcgtgtccagcgtgaacatgatctcccggatgctcatcaaccgcttcaccatgcggcacaagaaggcgacgtacgagccggacgtcgacctggggagcggcacccgcaacatcgggatcgagtccgagatccccaacctggacatcatcggcaagcgcatcgagaagatcaagcaggagcacgagaccctctggcactacgaccaggaccacccctacaagacctgggcctaccacgggagctacgagacgaagcagaccggctccgccagctccatggtgaacggcgtggtccggctgctgaccaagccctgggacgtggtgccgatggtcacccagatggccatgacggacaccacccccttcgggcagcagcgcgtgttcaaggagaaggtggacacccggacgcaggagcccaaggagggcaccaagaagctcatgaagatcaccgccgagtggctgtggaaggagctggggaagaagaagacgccccggatgtgcacgcgggaggagttcacccgcaaggtccggagcaacgcggccctcggcgccatcttcaccgacgagaacaagcgcaagtccgcccgggaggccgtggaggacagccgcttctgggagctggtcgacaaggagcggaacctgcacctcgagggcaagtgcgagacctgcgtgtacaacatgatggggaagcgcgagaagaagctgggcgagttcgggaaggcgaagggctcccgggccatctggtacatgtggctgggggcccgcttcctcgagttcgaggccctgggcttcctgaacgaggaccactggttcagccgggagaacagcctctccggcgtggagggggagggcctgcacaagctggggtacatcctccgcgacgtcagcaagaaggagggcggggcgatgtacgccgacgacacggccggctgggacacccggatcaccctggaggacctgaagaacgaggagatggtgaccaaccacatggagggcgagcacaagaagctcgccgaggccatcttcaagctgacgtaccagaacaaggtggtccgcgtgcagcggccgacgccccgcgggaccgtgatggacatcatctcccggcgcgaccagcgcggcagcgggcaggtcggcacctacgggctgaacaccttcaccaacatggaggcgcagctcatccggcagatggagggcgagggcgtgttcaagtccatccagcacctgaccgtgaccgaggagatcgccgtccagaactggctggcccgcgtggggcgggagcgcctcagccggatggccatctccggcgacgactgcgtggtcaagcccctggacgaccgcttcgccagcgcgctgacggccctcaacgacatggggaaggtgcggaaggacatccagcagtgggagccctcccgcggctggaacgactggacccaggtgccgttctgcagccaccacttccacgagctgatcatgaaggacggccgggtcctggtggtgccctgccgcaaccagaacgagctcatcgggcgggcccgcatctcccagggcgccgggtggagcctgcgggagaccgcctgcctgggcaagtcctacgcgcagatgtggagcctcatgtacttccaccgccgggacctgcgcctggccgccaacgccatctgctccgccgtccccagccactgggtgcccacctcccggacgacctggagcatccacgcgaagcacgagtggatgaccaccgaggacatgctcaccgtgtggaaccgcgtctggatccaggagaacccgtggatggaggacaagacgagcgtggagtcctgggaggagatcccctacctggggaagcgggaggaccagtggtgcggcagcctgatcggcctcacctcccgcgccacctgggccaagaacatccagaccgccatcaaccaggtgcgcagcctgatcgggaacgaggagtacacggactacatgccctccatgaagcggttccgccgggaggaggaggaggcgggcgtcctgtggtga

SEQ ID NO: 9793 - RNA, 9876 nt, synthetic construct
  misc_feature 1..9876: note = derived and/or modified CDS sequence (opt1) from DENV-2__DQ645540__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacgcggaccgagacctggatgtccagcgagggcgcctggaagcacgcccagcggatcgagacctgggtgctccgccaccccgggttcacgatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgaccaagaccgaggccaagcaccccgccaccctgcgcaagtactgcatcgaggccaagctcacgaacaccaccaccgcgagccggtgcccgacgcagggggagccctccctgaacgaggagcaggacaagcgcttcgtgtgcaagcacagcatggtggaccggggctggggcaacgggtgcggcctgttcgggaagggcgggatcgtgacctgcgccatgttcacgtgcaagaagaacatggagggcaaggtggtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagacgctggtgaccttcaagaacccccacgccaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgcggagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacgtggaccgagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaaggcgtggggcaaggccaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcacgaccgtggtcgtgaccgaggactgcgggaaccggggccccagcctgcgcaccacgaccgcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcacggccggccacgggcagatcgacaacttcagcctcggcgtgctgggcatggcgctgttcctcgaggagatgctgcggacccgcgtggggaccaagcacgccatcctgctcgtcgccgtgtccttcgtgaccctgatcacgggcaacatgagcttccgggacctggggcgcgtcatggtgatggtgggcgccaccatgaccgacgacatcgggatgggcgtcacctacctcgccctgctggcggccttcaaggtgcgccccacgttcgccgccggcctcctgctgcggaagctcacctccaaggagctgatgatgaccaccatcgggatcgtcctgctcagccagtccacgatccccgagaccatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcacgatcctcgcggtggtgtccgtcagccccctgctgctcacctccagccagcagaaggccgactggatccccctggccctgaccatcaaggggctcaaccccaccgccatcttcctgacgaccctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcacggtgtgctacgtgctgaccgggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgacgatcctcatccgcaccggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacgcggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagaccaagcccgggctgttcaagaccaacaccggcacgatcggggccgtgagcctggacttctcccccggcaccagcggctcccccatcgtcgacaagaaggggaaggtggtgggcctctacgggaacggcgtcgtgacccgcagcggcacctacgtgtccgcgatcgcccagacggagaagtccatcgaggacaaccccgagatcgaggacgacatcttccggaagaagcgcctgaccatcatggacctgcaccccggggccggcaagaccaagcggtacctgcccgccatcgtccgcgaggcgatcaagcgggggctccgcaccctgatcctggccccgacgcgggtggtggccgccgagatggaggaggccctccgcggcctgcccatccgctaccagacccccgcgatccgggccgagcacaccgggcgcgagatcgtcgacctgatgtgccacgccaccttcacgatgcggctcctgagccccatccgcgtgccgaactacaacctgatcatcatggacgaggcccacttcaccgaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacgcgcaccaacgactgggacttcgtggtcaccaccgacatcagcgagatgggcgcgaacttcaaggccgagcgggtgatcgacccccgccggtgcatgaagcccgtgatcctgacggacggggaggagcgcgtcatcctcgccggccccatgccggtgacccactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggacgaaggagggggagcggaagaagctcaagccgcgctggctggacgcccggatctacagcgaccccctggccctcaaggagttcaaggagttcgcggccggccgcaagtccctgaccctgaacctcatcaccgagatgggccggctgcccaccttcatgacgcagaaggcccgcaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgcgatcctcaccgtggtcgccgccaccatggccaacgagatgggcttcctggagaagacgaagaaggacttcgggctgggcggcatcgccacccagcagccggagagcaacatcctcgacatcgacctgcggcccgcgagcgcctggaccctgtacgccgtggccaccacgttcatcacccccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcacgctgaccgccgcgctgctcctgctggtggcccactacgccatcatcggccccggcctccaggccaaggccacccgggaggcgcagaagcgcgccgccgccgggatcatgaagaaccccaccgtggacggcatcacggtcatcgacctggacccgatcccctacgaccccaagttcgagaagcagctggggcaggtcatgctcctggtgctgtgcgtcacccaggtgctcatgatgcggaccacctgggccctgtgcgaggcgctgacgctcgccaccggccccatctccaccctgtgggaggggaacccgggccgcttctggaacaccacgatcgccgtgagcatggccaacatcttccgcggctcctacctggccggggcgggcctcctgttcagcatcatgaagaacaccgccaacacccggcgcgggaccggcaacacgggcgagaccctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacgcccgagggcaaggtgatggacctggggtgcggccgcggcgggtggtcctactactgcggcgggctcaagaacgtgaaggaggtcaaggggctgaccaagggcgggcccgggcacgaggagcccatcccgatgagcacctacggctggaacctggtgcgcctccagtccggggtggacgtcttcttcacgccgcccgagaagtgcgacacgctgctgtgcgacatcggcgagagctcccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcacgatgcgccacaagaaggccacctacgagcccgacgtggacctgggctccgggacccggaacatcggcatcgagagcgagatccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggtcaaggtggacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtcgaggacagcgggttctgggagctggtggacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtcgagggggagggcctgcacaagctgggctacatcctccgggacgtgagcaagaaggagggcggcgccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtcgtgcgggtgcagcgccccacgccccgggggaccgtcatggacatcatctcccgccgggaccagcgcggcagcggccaggtggtgacgtacgggctgaacaccttcaccaacatggaggcccagctcatccggcagatggagggcgagggggtcttcaagtccatccagcagctgaccgccacggaggagatcgccgtgaagaactggctggcccgcgtgggccgcgagcggctcagccgcatggcgatctccggcgacgactgcgtcgtgaagcccctggacgaccggttcgccagcgccctgaccgccctcaacgacatggggaaggtgcgcaaggacatccagcagtgggagccgtcccggggctggaacgactggacccaggtccccttctgcagccaccacttccacgagctgatcatgaaggacgggcgcgtgctggtggtcccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtgcccagccactgggtgccgacgtcccgcaccacctggagcatccacgccacccacgagtggatgaccacggaggacatgctcaccgtctggaaccgggtgtggatccaggagaacccctggatcgaggacaagacccccgtggagtcctgggaggagatcccctacctggggaagcgcgaggaccagtggtgcggcagcctgatcgggctcaccagccgggccacgtgggcgaagaacatccagaccgccatcaaccaggtccgctccctgatcggcaacgaggagtacaccgactacatgccgagcatgaagcggttccgccgcgaggaggaggaggccggggtgctgtggtga

SEQ ID NO: 9794 - RNA, 9876 nt, synthetic construct
  misc_feature 1..9876: note = derived and/or modified CDS sequence (opt1) from DENV-2__DQ645541__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacgcggaccgagacctggatgtccagcgagggcgcctggaagcacgcccagcggatcgagacctgggtgctccgccaccccgggttcacgatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgaccaagaccgaggccaagcaccccgccaccctgcgcaagtactgcatcgaggccaagctcacgaacaccaccaccgcgagccggtgcccgacgcagggggagccctccctgaacgaggagcaggacaagcgcttcgtgtgcaagcacagcatggtggaccggggctggggcaacgggtgcggcctgttcgggaagggcgggatcgtgacctgcgccatgttcacgtgcaagaagaacatggagggcaaggtggtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagacgctggtgaccttcaagaacccccacgccaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgcggagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacgtggaccgagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaaggcgtggggcaaggccaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcacgaccgtggtcgtgaccgaggactgcgggaaccggggccccagcctgcgcaccacgaccgcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcacggccggccacgggcagatcgacaacttcagcctcggcgtgctgggcatggcgctgttcctcgaggagatgctgcggacccgcgtggggaccaagcacgccatcctgctcgtcgccgtgtccttcgtgaccctgatcacgggcaacatgagcttccgggacctggggcgcgtcatggtgatggtgggcgccaccatgaccgacgacatcgggatgggcgtcacctacctcgccctgctggcggccttcaaggtgcgccccacgttcgccgccggcctcctgctgcggaagctcacctccaaggagctgatgatgaccaccatcgggatcgtcctgctcagccagtccacgatccccgagaccatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcacgatcctcgcggtggtgtccgtcagccccctgctgctcacctccagccagcagaaggccgactggatccccctggccctgaccatcaaggggctcaaccccaccgccatcttcctgacgaccctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcacggtgtgctacgtgctgaccgggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgacgatcctcatccgcaccggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacgcggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagaccaagcccgggctgttcaagaccaacaccggcacgatcggggccgtgagcctggacttctcccccggcaccagcggctcccccatcgtcgacaagaaggggaaggtggtgggcctctacgggaacggcgtcgtgacccgcagcggcacctacgtgtccgcgatcgcccagacggagaagtccatcgaggacaaccccgagatcgaggacgacatcttccggaagaagcgcctgaccatcatggacctgcaccccggggccggcaagaccaagcggtacctgcccgccatcgtccgcgaggcgatcaagcgggggctccgcaccctgatcctggccccgacgcgggtggtggccgccgagatggaggaggccctccgcggcctgcccatccgctaccagacccccgcgatccgggccgagcacaccgggcgcgagatcgtcgacctgatgtgccacgccaccttcacgatgcggctcctgagccccatccgcgtgccgaactacaacctgatcatcatggacgaggcccacttcaccgaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacgcgcaccaacgactgggacttcgtggtcaccaccgacatcagcgagatgggcgcgaacttcaaggccgagcgggtgatcgacccccgccggtgcatgaagcccgtgatcctgacggacggggaggagcgcgtcatcctcgccggccccatgccggtgacccactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggacgaaggagggggagcggaagaagctcaagccgcgctggctggacgcccggatctacagcgaccccctggccctcaaggagttcaaggagttcgcggccggccgcaagtccctgaccctgaacctcatcaccgagatgggccggctgcccaccttcatgacgcagaaggcccgcaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgcgatcctcaccgtggtcgccgccaccatggccaacgagatgggcttcctggagaagacgaagaaggacttcgggctgggcggcatcgccacccagcagccggagagcaacatcctcgacatcgacctgcggcccgcgagcgcctggaccctgtacgccgtggccaccacgttcatcacccccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcacgctgaccgccgcgctgctcctgctggtggcccactacgccatcatcggccccggcctccaggccaaggccacccgggaggcgcagaagcgcgccgccgccgggatcatgaagaaccccaccgtggacggcatcacggtcatcgacctggacccgatcccctacgaccccaagttcgagaagcagctggggcaggtcatgctcctggtgctgtgcgtcacccaggtgctcatgatgcggaccacctgggccctgtgcgaggcgctgacgctcgccaccggccccatctccaccctgtgggaggggaacccgggccgcttctggaacaccacgatcgccgtgagcatggccaacatcttccgcggctcctacctggccggggcgggcctcctgttcagcatcatgaagaacaccgccaacacccggcgcgggaccggcaacacgggcgagaccctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacgcccgagggcaaggtgatggacctggggtgcggccgcggcgggtggtcctactactgcggcgggctcaagaacgtgaaggaggtcaaggggctgaccaagggcgggcccgggcacgaggagcccatcccgatgagcacctacggctggaacctggtgcgcctccagtccggggtggacgtcttcttcacgccgcccgagaagtgcgacacgctgctgtgcgacatcggcgagagctcccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcacgatgcgccacaagaaggccacctacgagcccgacgtggacctgggctccgggacccggaacatcggcatcgagagcgagacccccaacctcgacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtcgtgcgcctgctgacgaagccgtgggacgtcatccccatggtgacccagatggccatgaccgacaccacgcccttcggccagcagcgggtgttcaaggagaaggtcgacacccgcacccaggagcccaaggagggcaccaagaagctcatgaagatcacggcggagtggctgtggaaggagctggggaagaagaagaccccgcggatgtgcacccgcgaggagttcacccggaaggtgcgcagcaacgccgccctcggcgccatcttcacggacgagaacaagtggaagtccgcccgggaggcggtggaggacagcgggttctgggagctggtcgacaaggagcgcaacctgcacctcgagggcaagtgcgagacctgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggcgccatgtacgccgacgacaccgccgggtgggacacccgcatcacgctggaggacctgaagaacgaggagatggtgaccaaccacatggagggcgagcacaagaagctcgccgaggcgatcttcaagctgacctaccagaacaaggtggtccgggtgcagcgccccacgccccgggggacggtgatggacatcatctcccgccgggaccagcgcggcagcggccaggtcgtgacctacgggctgaacaccttcaccaacatggaggcccagctcatccggcagatggagggcgagggggtgttcaagtccatccagcagctgacggccaccgaggagatcgccgtcaagaactggctggcccgcgtgggccgcgagcggctcagccgcatggcgatctccggcgacgactgcgtggtcaagcccctggacgaccggttcgccagcgccctgaccgccctcaacgacatggggaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggcgggctggagcctgcgcgagacggcctgcctgggcaagtcctacgcccagatgtggagcctcatgtacttccaccggcgcgacctgcggctggccgccaacgcgatctgctccgccgtccccagccactgggtgccgacctcccgcaccacctggagcatccacgccacccacgagtggatgacgaccgaggacatgctcaccgtgtggaaccgggtctggatccaggagaacccctggatcgaggacaagacccccgtggagtcctgggaggagatcccctacctggggaagcgcgaggaccagtggtgcggcagcctgatcgggctcacgagccgggccacctgggcgaagaacatccagaccgccatcaaccaggtgcgctccctgatcggcaacgaggagtacaccgactacatgccgagcatgaagcggttccgccgcgaggaggaggaggccggggtcctgtggtga

SEQ ID NO: 9795 - RNA, 9876 nt, synthetic construct
  misc_feature 1..9876: note = derived and/or modified CDS sequence (opt1) from DENV-2__DQ645542__SS-prME
  source 1..9876: mol_type = other RNA
accgccggcgtgatcatcatgatgatccccaccgtcgtggccttccacctgaccacccggaacggggagccccacatgatcgtgagccggcaggagaagggcaagagcctcctgttcaagaccgagaacggggtcaacatgtgcaccctgatggcgatggacctcggcgagctgtgcgaggacaccatcacctacaactgccccctgctccggcagaacgagcccgaggacatcgactgctggtgcaacagcaccagcacctgggtgacctacgggacctgcaccgccaccggcgagcaccggcgcgagaagcggagcgtggccctggtcccccacgtgggcatggggctggagacgcggaccgagacctggatgtccagcgagggcgcctggaagcacgcccagcggatcgagacctgggtgctccgccaccccgggttcacgatcatggcggccatcctggcctacaccatcggcaccacctacttccagcgggtcctgatcttcatcctcctgacggccgtggcgccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgaccaagaccgaggccaagcaccccgccaccctgcgcaagtactgcatcgaggccaagctcacgaacaccaccaccgcgagccggtgcccgacgcagggggagccctccctgaacgaggagcaggacaagcgcttcgtgtgcaagcacagcatggtggaccggggctggggcaacgggtgcggcctgttcgggaagggcgggatcgtgacctgcgccatgttcacgtgcaagaagaacatggagggcaaggtggtgcagcccgagaacctcgagtacaccatcgtcatcacgccccactccggcgaggagaacgccgtggggaacgacaccggcaagcacgggaaggagatcaaggtgaccccgcagagctccatcaccgaggccgagctgaccggctacgggacggtcaccatggagtgcagcccccgcaccggcctggacttcaacgagatggtgctcctgcagatggaggacaaggcctggctggtccaccggcagtggttcctcgacctgcccctgccctggctcccgggcgcggacacccaggggtccaactggatccagaaggagacgctggtgaccttcaagaacccccacgccaagaagcaggacgtggtcgtgctgggcagccaggagggggccatgcacaccgccctcaccggcgccacggagatccagatgagctccgggaacctgctgttcaccggccacctcaagtgccgcctgcggatggacaagctgcagctcaagggcatgagctactccatgtgcaccgggaagttcaaggtggtcaaggagatcgcggagacccagcacggcacgatcgtgatccgcgtgcagtacgagggggacggcagcccctgcaagatccccttcgagatcatggacctggagaagcggcacgtcctgggccgcctcatcaccgtgaacccgatcgtgaccgagaaggactcccccgtcaacatcgaggccgagccgcccttcggggacagctacatcatcatcggcgtggagccggggcagctgaagctgtcctggttcaagaagggcagctccatcgggcagatgttcgagaccacgatgcgcggcgccaagcggatggccatcctcggcgacaccgcctgggacttcgggagcctgggcggggtgttcacctccatcggcaaggcgctgcaccaggtcttcggggccatctacggcgccgccttcagcggcgtgtcctggaccatgaagatcctcatcggggtggtcatcacgtggatcggcatgaacagccgctccaccagcctgtccgtgagcctggtgctggtcggggtggtgaccctctacctgggcgtcatggtgcaggcggactccgggtgcgtggtcagctggaagaacaaggagctgaagtgcggcagcggcatcttcatcaccgacaacgtgcacacgtggaccgagcagtacaagttccagcccgagtcccccagcaagctcgcctccgccatccagaaggcccacgaggaggggatctgcggcatccggagcgtgacccgcctggagaacctgatgtggaagcagatcacccccgagctcaaccacatcctgtccgagaacgaggtcaagctgacgatcatgaccggggacatcaagggcatcatgcaggccgggaagcggagcctccgcccgcagcccaccgagctgaagtactcctggaaggcgtggggcaaggccaagatgctgagcaccgagctccacaaccacacgttcctgatcgacggccccgagaccgccgagtgcccgaacaccaaccgggcctggaactccctggaggtggaggactacgggttcggcgtgttcaccacgaacatctggctcaagctgaaggagcgccaggacgtcttctgcgacagcaagctgatgtccgccgcgatcaaggacaaccgggccgtgcacgccgacatggggtactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgcgggccccgtgagccagcacaactaccgcccggggtaccacacccagaccgccggcccctggcacctcgggaagctggagatggacttcgacttctgcgagggcacgaccgtggtcgtgaccgaggactgcgggaaccggggccccagcctgcgcaccacgaccgcctccggcaagctcatcaccgagtggtgctgccggagctgcaccctgcccccgctgcgctaccgcggggaggacggctgctggtacgggatggagatccgccccctcaaggagaaggaggagaacctggtgaactccctggtcacggccggccacgggcagatcgacaacttcagcctcggcgtgctgggcatggcgctgttcctcgaggagatgctgcggacccgcgtggggaccaagcacgccatcctgctcgtcgccgtgtccttcgtgaccctgatcacgggcaacatgagcttccgggacctggggcgcgtcatggtgatggtgggcgccaccatgaccgacgacatcgggatgggcgtcacctacctcgccctgctggcggccttcaaggtgcgccccacgttcgccgccggcctcctgctgcggaagctcacctccaaggagctgatgatgaccaccatcgggatcgtcctgctcagccagtccacgatccccgagaccatcctggagctgaccgacgccctcgcgctgggcatgatggtgctgaagatcgtgcgcaacatggagaagtaccagctcgccgtcaccatcatggccatcctgtgcgtgccgaacgccgtgatcctgcagaacgcctggaaggtcagctgcacgatcctcgcggtggtgtccgtcagccccctgctgctcacctccagccagcagaaggccgactggatccccctggccctgaccatcaaggggctcaaccccaccgccatcttcctgacgaccctgtcccggaccagcaagaagcgctcctggccgctcaacgaggcgatcatggccgtgggcatggtgagcatcctggcctccagcctgctcaagaacgacatccccatgaccggccccctggtcgccgggggcctgctcacggtgtgctacgtgctgaccgggcggagcgccgacctggagctcgagcgcgcggccgacgtccggtgggaggagcaggccgagatctccggcagctcccccatcctgagcatcaccatctccgaggacgggagcatgtccatcaagaacgaggaggaggagcagaccctgacgatcctcatccgcaccggcctgctggtgatcagcggcctcttcccggtgtccatccccatcaccgccgccgcgtggtacctgtgggaggtcaagaagcagcgggccggggtgctgtgggacgtgcccagcccgccgcccgtcggcaaggccgagctcgaggacggggcctaccgcatcaagcagaagggcatcctggggtactcccagatcggcgccggcgtgtacaaggaggggaccttccacaccatgtggcacgtgacgcggggcgcggtcctgatgcacaaggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggccgtgcagaccaagcccgggctgttcaagaccaacaccggcacgatcggggccgtgagcctggacttctcccccggcaccagcggctcccccatcgtcgacaagaaggggaaggtggtgggcctctacgggaacggcgtcgtgacccgcagcggcacctacgtgtccgcgatcgcccagacggagaagtccatcgaggacaaccccgagatcgaggacgacatcttccggaagaagcgcctgaccatcatggacctgcaccccggggccggcaagaccaagcggtacctgcccgccatcgtccgcgaggcgatcaagcgggggctccgcaccctgatcctggccccgacgcgggtggtggccgccgagatggaggaggccctccgcggcctgcccatccgctaccagacccccgcgatccgggccgagcacaccgggcgcgagatcgtcgacctgatgtgccacgccaccttcacgatgcggctcctgagccccatccgcgtgccgaactacaacctgatcatcatggacgaggcccacttcaccgaccccgcctccatcgcggcccggggctacatcagcacccgcgtggagatgggcgaggccgccgggatcttcatgaccgccacgccgcccggctcccgggacccgttcccccagagcaacgcgcccatcatggacgaggagcgcgagatccccgagcggtcctggaacagcgggcacgagtgggtcaccgacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacgcgcaccaacgactgggacttcgtggtcaccaccgacatcagcgagatgggcgcgaacttcaaggccgagcgggtgatcgacccccgccggtgcatgaagcccgtgatcctgacggacggggaggagcgcgtcatcctcgccggccccatgccggtgacccactccagcgccgcccagcggcgcgggcgggtcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccggaagaccttcgtggacctgatgcgccggggcgacctccccgtctggctggcctaccgcgtggcggccgaggggatcaactacgccgaccggcgctggtgcttcgacggcgtgaagaacaaccagatcctggaggagaacgtcgaggtggagatctggacgaaggagggggagcggaagaagctcaagccgcgctggctggacgcccggatctacagcgaccccctggccctcaaggagttcaaggagttcgcggccggccgcaagtccctgaccctgaacctcatcaccgagatgggccggctgcccaccttcatgacgcagaaggcccgcaacgccctggacaacctcgcggtgctgcacaccgccgaggccgggggccgggcctacaaccacgccctgagcgagctccccgagaccctggagaccctgctcctgctgacgctcctggcgaccgtcaccgggggcatcttcctgttcctcatgtccggcaaggggatcggcaagatgaccctggggatgtgctgcatcatcaccgccagcgtgctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgcgatcctcaccgtggtcgccgccaccatggccaacgagatgggcttcctggagaagacgaagaaggacttcgggctgggcggcatcgccacccagcagccggagagcaacatcctcgacatcgacctgcggcccgcgagcgcctggaccctgtacgccgtggccaccacgttcatcacccccatgctccgccactccatcgagaacagctccgtgaacgtcagcctgaccgccatcgcgaaccaggccaccgtgctgatggggctcggcaaggggtggcccctgtccaagatggacatcggcgtgccgctgctcgccatcgggtgctacagccaggtcaaccccatcacgctgaccgccgcgctgctcctgctggtggcccactacgccatcatcggccccggcctccaggccaaggccacccgggaggcgcagaagcgcgccgccgccgggatcatgaagaaccccaccgtggacggcatcacggtcatcgacctggacccgatcccctacgaccccaagttcgagaagcagctggggcaggtcatgctcctggtgctgtgcgtcacccaggtgctcatgatgcggaccacctgggccctgtgcgaggcgctgacgctcgccaccggccccatctccaccctgtgggaggggaacccgggccgcttctggaacaccacgatcgccgtgagcatggccaacatcttccgcggctcctacctggccggggcgggcctcctgttcagcatcatgaagaacaccgccaacacccggcgcgggaccggcaacacgggcgagaccctgggggagaagtggaagaaccggctcaacgccctgggcaagtccgagttccagatctacaagaagtccgggatccaggaggtcgaccgcaccctggccaaggagggcatcaagcgcggggagaccgaccaccacgcggtgtcccgcggcagcgccaagctccggtggttcgtggagcgcaacctggtcacgcccgagggcaaggtgatggacctggggtgcggccgcggcgggtggtcctactactgcggcgggctcaagaacgtgaaggaggtcaaggggctgaccaagggcgggcccgggcacgaggagcccatcccgatgagcacctacggctggaacctggtgcgcctccagtccggggtggacgtcttcttcacgccgcccgagaagtgcgacacgctgctgtgcgacatcggcgagagctcccccaacccgaccgtggaggccggccggaccctccgcgtgctgaacctggtcgagaactggctcaacaacaacacccagttctgcatcaaggtgctgaacccctacatgcccagcgtgatcgagaagatggaggccctgcagcggaagtacgggggcgccctggtccgcaacccgctcagccggaactccacccacgagatgtactgggtgagcaacgcgtccgggaacatcgtgagctccgtcaacatgatcagccgcatgctgatcaaccggttcacgatgcgccacaagaaggccacctacgagcccgacgtggacctgggctccgggacccggaacatcggcatcgagagcgagatccccaacctcgacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctgaccaagccgtgggacgtcatccccatggtgacgcagatggccatgaccgacaccacccccttcggccagcagcgggtgttcaaggagaaggtcgacacgcgcacccaggagcccaaggagggcaccaagaagctcatgaagatcaccgcggagtggctgtggaaggagctggggaagaagaagacgccgcggatgtgcacccgcgaggagttcacccggaaggtgcgcagcaacgccgccctcggcgccatcttcaccgacgagaacaagtggaagtccgcccgggaggcggtggaggacagcgggttctgggagctggtcgacaaggagcgcaacctgcacctcgagggcaagtgcgagacgtgcgtgtacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcgagaactccctcagcggcgtggagggggagggcctgcacaagctgggctacatcctccgggacgtcagcaagaaggagggcggcgccatgtacgccgacgacaccgccgggtgggacacccgcatcaccctggaggacctgaagaacgaggagatggtgacgaaccacatggagggcgagcacaagaagctcgccgaggcgatcttcaagctgacctaccagaacaaggtggtccgggtgcagcgccccacgccccgggggaccgtgatggacatcatctcccgccgggaccagcgcggcagcggccaggtcgtgacgtacgggctgaacaccttcaccaacatggaggcccagctcatccggcagatggagggcgagggggtgttcaagtccatccagcagctgaccgccacggaggagatcgccgtcaagaactggctggcccgcgtgggccgcgagcggctcagccgcatggcgatctccggcgacgactgcgtggtcaagcccctggacgaccggttcgccagcgccctgaccgccctcaacgacatggggaaggtgcgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggcgggctggagcctgcgcgagaccgcctgcctgggcaagtcctacgcccagatgtggagcctcatgtacttccaccggcgcgacctgcggctggccgccaacgcgatctgctccgccgtccccagccactgggtgccgacgtcccgcaccacctggagcatccacgccacccacgagtggatgaccacggaggacatgctcaccgtgtggaaccgggtctggatccaggagaacccctggatcgaggacaagacccccgtggagtcctgggaggagatcccctacctggggaagcgcgaggaccagtggtgcggcagcctgatcgggctcaccagccgggccacgtgggcgaagaacatccagaccgccatcaaccaggtgcgctccctgatcggcaacgaggagtacaccgactacatgccgagcatgaagcggttccgccgcgaggaggaggaggccggggtcctgtggtga

SEQ ID NO: 9796 - RNA, 9876 nt, synthetic construct
  misc_feature 1..9876: note = derived and/or modified CDS sequence (opt1) from DENV-2__AY702036__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccacctccacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttctccaccaacatctggctcaagctgcgcgagaagcaggacgtgttctgcgacagcaagctgatgtccgccgccatcaaggacaaccgggcggtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagacggcggggccctggcacctcggcaagctggagatggacttcgacttctgcgaggggaccaccgtggtggtcaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtgaactccctggtgaccgccgggcacggccagatcgacaacttcagcctcggcgtcctggggatggccctgttcctcgaggagatgctgcggacccgcgtgggcaccaagcacgcgatcctgctcgtggccgtctccttcgtgacgctgatcaccgggaacatgagcttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcacctccaaggagctgatgatggccaccatcggcatcgccctgctcagccagtccacgatgcccgagaccatcctggagctgaccgacgcgctcgccctggggatgatggtgctgaagatcgtgcgcaacatggagaagtaccagctcgccgtcaccatcatggccatcagctgcgtgccgaacgccgtgatcctgcagaacgcgtggaaggtctcctgcacgatcctggccgccgtgagcgtcagccccctcctgctgaccagctcccagcagaaggccgactggatccccctcgcgctgaccatcaagggcctgaaccccaccgccatcttcctcacgaccctgagccggacctccaagaagcgcagctggccgctgaacgaggccatcatggccgtgggcatggtgtccatcctcgccagcagcctgctgaagaacgacatccccatgaccgggcccctcgtcgcgggcgggctgctgacggtgtgctacgtgctcaccggccggtccgccgacctggagctggagcgcgccgccgacgtcaagtgggaggaccaggccgagatcagcgggtccagccccatcctctccatcaccatcagcgaggacggctccatgagcatcaagaacgaggaggaggagcagaccctgacgatcctgatccggaccggcctcctggtgatctccggggtgttcccggtcagcatccccatcaccgcggccgcctggtacctgtgggaggtgaagaagcagcgcgccggcgtgctctgggacgtccccagcccgccgcccgtggggaaggccgagctggaggacggcgcgtaccggatcaagcagcgcgggatcctgggctacagccagatcggcgccggggtgtacaaggagggcaccttccacaccatgtggcacgtcacgcgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgcggtgcagaccaagcccggcatcttcaagaccaacaccgggacgatcggcgccgtctccctggacttcagccccggcacctccgggagccccatcgtggaccggaagggcaaggtggtcgggctctacggcaacggcgtggtgacccgctccggggcctacgtcagcgccatcgcgcagaccgagaagtccatcgaggacaaccccgagatcgaggacgacatcttccggaagaagcgcctgacgatcatggacctgcaccccggcgccgggaagaccaagcggtacctccccgccatcgtgcgcgaggccatcaaccggggcctgcgcaccctgatcctggccccgacccgcgtggtcgcggccgagatggaggaggccctccgggggctgcccatccgctaccagacgcccgccatccgggccgagcacaccggccgcgagatcgtggacctgatgtgccacgcgaccttcaccatgcggctcctgtcccccgtgcgcgtcccgaactacaacctgatcatcatggacgaggcccacttcacggaccccgccagcatcgccgcccggggctacatctccacccgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtctggttcgtgccgagcatcaaggcgggcaacgacatcgccgcctgcctccgcaagaacggcaagaaggtgatccagctgtcccggaagaccttcgacagcgagtacgtcaagacccgcgccaacgactgggacttcgtggtgacgaccgacatctccgagatgggggccaacttcaaggcggagcgggtcatcgacccccgccggtgcatgaagcccgtgatcctgaccgacggcgaggagcgcgtgatcctcgccgggcccatgccggtcacccacagctccgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacgcccgagggcatcatcccgagcatgttcgagcccgagcgcgagaaggtggacgccatcgacggggagtaccggctgcgcggcgaggcccggaagaccttcgtggacctgatgcgccgcggggacctccccgtctggctggcctacaaggtggccgcggagggcatcaactacgccgaccgcaagtggtgcttcgacgggatcaagaacaaccagatcctggaggagaacgtggaggtcgagatctggaccaaggagggcgagcggaagaagctcaagccgcgctggctggacgcccggatctactccgaccccctggccctcaaggagttcaaggagttcgcggccggccgcaagagcctgaccctgaacctcatcacggagatggggcggctgcccaccttcatgacccagaaggcccgcaacgccctggacaacctcgccgtgctgcacaccgcggaggccggcgggcgggcctacaaccacgccctgtccgagctccccgagacgctggagaccctgctcctgctgaccctcctggccaccgtcacgggcggcatcttcctgttcctcatgagcgggaagggcatcgggaagatgaccctgggcatgtgctgcatcatcaccgcgtccagcctgctctggtacgcccagatccagccgcactggatcgccgccagcatcatcctggagttcttcctgatcgtgctcctgatccccgagcccgagaagcagcgcacgccccaggacaaccagctgacctacgtggtcatcgccatcctcacggtggtggcggccaccatggccaacgagatggggttcctggagaagaccaagaaggacctgggcctcggctccatcaccacgcaggagagcgagtccaacatcctggacatcgacctgcggccggccagcgcctggaccctctacgcggtcgccaccaccttcgtgacgcccatgctgcgccactccatcgagaacagctccgtgaacgtcagcctgaccgccatcgccaaccaggcgaccgtgctcatggggctgggcaaggggtggcccctgtccaagatggacatcggcgtgcccctcctggccatcgggtgctacagccaggtcaacccgatcaccctgacggccgccctcctgctgctcgtggcccactacgcgatcatcggccccggcctgcaggccaaggccacccgggaggcccagaagcgcgccgcggccgggatcatgaagaaccccaccgtggacggcatcaccgtcatcgacctggagcccatcccgtacgaccccaagttcgagaagcagctcgggcaggtcatgctgctgatcctctgcgtgacgcaggtcctgatgatgcggaccacctgggccctgtgcgaggccctcaccctggccacgggccccatctccaccctgtgggaggggaaccccggccgcttctggaacaccaccatcgcggtgagcatggccaacatcttccgcggctcctacctcgccggggccggcctgctgttcagcatcatgaagaacacgaccaacacccggcgcgggaccggcaacatcggcgagacgctcggggagaagtggaagtcccggctgaacgcgctgggcaagagcgagttccagatctacaagaagtccgggatccaggaggtggaccgcaccctcgccaaggagggcatcaagcgcggggagaccgaccaccacgccgtcagccgcggctccgccaagctgcggtggttcgtggagcgcaacatggtgaccccggagggcaaggtcgtggacctggggtgcggccgcgggggctggagctactactgcgggggcctcaagaacgtgcgcgaggtcaagggcctgacgaagggcggccccgggcacgaggagcccatccccatgagcacctacggctggaacctggtgcggctccagtccggggtggacgtcttcttcaccccgcccgagaagtgcgacaccctgctgtgcgacatcggcgagagctcccccaaccccacgatcgaggccggccgcaccctccgggtgctgaacctggtggagaactggctcaacaacaacacccagttctgcatcaaggtcctgaacccgtacatgcccagcgtgatcgagaagatggagaccctgcagcgcaagtacgggggcgcgctcgtgcggaaccccctgtcccgcaacagcacccacgagatgtactgggtctccaacgccacggggaacatcgtgagctccgtgaacatgatcagccggatgctgatcaaccgcttcaccatgaagcacaagaaggccacctacgagccggacgtcgacctgggctccgggacccggaacatcggcatcgagagcgagatccccaacctcgacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtggtccgcctgctgacgaagccctgggacgtggtgccgatggtcacccagatggcgatgaccgacaccacgcccttcggccagcagcgggtgttcaaggagaaggtggacacccgcacccaggagcccaaggagggcaccaagaagctcatgaagatcacggccgagtggctgtggaaggagctggggaagaagaagacgccccggatgtgcacccgcgaggagttcacccggaaggtccgcagcaacgccgccctcggcgccatcttcacggacgagaacaagtggaagtccgcgcgggaggccgtggaggacgggcgcttctgggagctggtggaccgggagcgcaacctgcacctcgagggcaagtgcgagacctgcgtctacaacatgatggggaagcgggagaagaagctgggcgagttcggcaaggccaaggggagccgcgccatctggtacatgtggctgggcgcgcggttcctcgagttcgaggccctggggttcctgaacgaggaccactggttcagccgcggcaactccctcagcggggtggagggcgagggcctgcaccggctggggtacatcctccgcgaggtcggcaagaaggagggcggcgccatgtacgccgacgacaccgccgggtgggacacccggatcacgctggaggacctgaagaacgaggagatggtgaccaaccacatgaagggcgagcacaagaagctcgcggaggccatcttcaagctgacctaccagaacaaggtggtccgcgtgcagcggccgacgccccggggcacggtgatggacatcatctcccggcgcgaccagcgcgggagcggccaggtcgggacctacggcctgaacaccttcaccaacatggaggcccagctcatccggcagatggagggcgaggggatcttcaagtccatccagcacctgacggccaccgaggagatcgccgtgcagaactggctggcgcgcgtgggccgggagcgcctcagccggatggccatctccggggacgactgcgtcgtgaagcccatcgacgaccgcttcgccagcgccctgaccgccctgaacgacatgggcaaggtgcggaaggacatccagcagtgggagccctcccgcgggtggaacgactggacccaggtcccgttctgcagccaccacttccacgagctcgtgatgaaggacggccgggtgctggtcgtgccctgccgcaaccaggacgagctgatcggccgggcgcgcatctcccagggggccggctggagcctcaaggagacggcctgcctggggaagtcctacgcccagatgtggaccctgatgtacttccaccggcgcgacctccggctggccgcgaacgccatctgcagcgccgtgccctcccactgggtccccaccagccgcaccacctggtccatccacgccaagcacgagtggatgacgaccgaggacatgctggcggtgtggaaccgggtgtggatccaggagaacccgtggatggaggacaagacccccgtcgagagctgggaggaggtgccctacctcggcaagcgcgaggaccagtggtgcgggagcctgatcggcctgacctcccgggccacgtgggccaagaacatccagaccgccatcaaccaggtgcgcagcctcatcggcaacgaggagtacaccgactacatgccctccatgaagcgcttccggcgcgaggaggaggaggccggggtcctgtggtga

SEQ ID NO: 9797 - RNA, 9876 nt, synthetic construct
  misc_feature 1..9876: note = derived and/or modified CDS sequence (opt1) from DENV-2__AY702034__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacttctgcgaggggaccaccgtggtggtcacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacccgcgtgggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatgcccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggggaaggccgagctggaggacggcgcgtaccggatcaagcagcgcgggatcctgggctactcccagatcggcgccggggtgtacaaggagggcaccttccacacgatgtggcacgtcacccgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgcggtgcagaccaagcccggcatcttcaagaccaacacggggaccatcggcgccgtcagcctggacttctcccccggcaccagcgggtcccccatcgtggaccggaagggcaaggtggtcgggctctacggcaacggcgtggtgacccgcagcggggcctacgtctccgccatcgcgcagacggagaagtccatcgaggacaaccccgagatcgaggacgacatcttccggaagaagcgcctgaccatcatggacctgcaccccggcgccgggaagaccaagcggtacctccccgccatcgtgcgcgaggccatcaaccggggcctgcgcaccctgatcctggccccgacgcgcgtggtcgcggccgagatggaggaggccctccgggggctgcccatccgctaccagacccccgccatccgggccgagcacaccggccgcgagatcgtggacctgatgtgccacgcgaccttcacgatgcggctcctgagccccgtgcgcgtcccgaactacaacctgatcatcatggacgaggcccacttcaccgaccccgcctccatcgccgcccggggctacatcagcacccgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagaccgtctggttcgtgccgtccatcaaggcgggcaacgacatcgccgcctgcctccgcaagaacggcaagaaggtgatccagctgagccggaagaccttcgactccgagtacgtcaagacgcgcgccaacgactgggacttcgtggtgaccaccgacatcagcgagatgggggccaacttcaaggcggagcgggtcatcgacccccgccggtgcatgaagcccgtgatcctgaccgacggcgaggagcgcgtgatcctcgccgggcccatgccggtcacgcactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgcgagaaggtggacgccatcgacggggagtaccggctgcgcggcgaggcccggaagaccttcgtggacctgatgcgccgcggggacctccccgtctggctggcctacaaggtggccgcggagggcatcaactacgccgaccgcaagtggtgcttcgacgggatcaagaacaaccagatcctggaggagaacgtggaggtcgagatctggaccaaggagggcgagcggaagaagctcaagccgcgctggctggacgcccggatctacagcgaccccctggccctcaaggagttcaaggagttcgcggccggccgcaagtccctgacgctgaacctcatcaccgagatggggcggctgcccaccttcatgacccagaaggcccgcaacgccctggacaacctcgccgtgctgcacacggcggaggccggcgggcgggcctacaaccacgccctgagcgagctccccgagaccctggagaccctgctcctgctgaccctcctggccacggtcaccggcggcatcttcctgttcctcatgtccgggaagggcatcgggaagatgaccctgggcatgtgctgcatcatcaccgcgagctccctgctctggtacgcccagatccagccgcactggatcgccgccagcatcatcctggagttcttcctgatcgtgctcctgatccccgagcccgagaagcagcgcacgccccaggacaaccagctgacgtacgtggtcatcgccatcctcaccgtggtggcggccaccatggccaacgagatggggttcctggagaagaccaagaaggacctgggcctcggcagcatcacgacccaggagtccgagagcaacatcctggacatcgacctgcggccggcctccgcctggaccctctacgcggtcgccaccacgttcgtgacccccatgctgcgccacagcatcgagaactccagcgtgaacgtctccctgaccgccatcgccaaccaggcgaccgtgctcatggggctgggcaaggggtggcccctgagcaagatggacatcggcgtgcccctcctggccatcgggtgctactcccaggtcaacccgatcacgctgaccgccgccctcctgctgctcgtggcccactacgcgatcatcggccccggcctgcaggccaaggccacccgggaggcccagaagcgcgccgcggccgggatcatgaagaaccccaccgtggacggcatcacggtcatcgacctggagcccatcccgtacgaccccaagttcgagaagcagctcgggcaggtcatgctgctgatcctctgcgtgacccaggtcctgatgatgcggaccacctgggccctgtgcgaggccctcacgctggccaccggccccatcagcaccctgtgggaggggaaccccggccgcttctggaacaccacgatcgcggtgtccatggccaacatcttccgcggcagctacctcgccggggccggcctgctgttctccatcatgaagaacaccaccaacacccggcgcgggacgggcaacatcggcgagaccctcggggagaagtggaagtcccggctgaacgcgctgggcaagtccgagttccagatctacaagaagtccgggatccaggaggtggaccgcaccctcgccaaggagggcatcaagcgcggggagaccgaccaccacgccgtctcccgcggcagcgccaagctgcggtggttcgtggagcgcaacatggtgacgccggagggcaaggtcgtggacctggggtgcggccgcggcgggtggtcctactactgcggcgggctcaagaacgtgcgcgaggtcaaggggctgaccaagggcggccccgggcacgaggagcccatccccatgagcacctacggctggaacctggtgcggctccagagcggggtggacgtcttcttcaccccgcccgagaagtgcgacacgctgctgtgcgacatcggcgagtccagccccaaccccaccatcgaggccggccgcaccctccgggtgctgaacctggtggagaactggctcaacaacaacacccagttctgcatcaaggtcctgaacccgtacatgccctccgtgatcgagaagatggagaccctgcagcgcaagtacgggggcgcgctcgtgcggaaccccctgagccgcaactccacgcacgagatgtactgggtcagcaacgccaccgggaacatcgtgtccagcgtgaacatgatctcccggatgctgatcaaccgcttcaccatgaagcacaagaaggccacctacgagccggacgtcgacctgggcagcgggacgcggaacatcggcatcgagtccgagatccccaacctcgacatcatcggcaagcgcatcgagaagatcaagcaggagcacgagaccagctggcactacgaccaggaccacccctacaagacctgggcctaccacgggtcctacgagaccaagcagacgggcagcgcctccagcatggtgaacggggtggtccgcctgctgaccaagccctgggacgtggtgccgatggtcacccagatggcgatgaccgacacgacccccttcggccagcagcgggtgttcaaggagaaggtggacacccgcacccaggagcccaaggagggcacgaagaagctcatgaagatcaccgccgagtggctgtggaaggagctggggaagaagaagacgccccggatgtgcacccgcgaggagttcacgcggaaggtccgctccaacgccgccctcggcgccatcttcaccgacgagaacaagtggaagtccgcgcgggaggccgtggaggacgggcgcttctgggagctggtggaccgggagcgcaacctgcacctcgagggcaagtgcgagacctgcgtctacaacatgatggggaagcgggagaagaagctgggcgagttcggcaaggccaaggggtcccgcgccatctggtacatgtggctgggcgcgcggttcctcgagttcgaggccctggggttcctgaacgaggaccactggttcagccgcggcaacagcctctccggggtggagggcgagggcctgcaccggctggggtacatcctccgcgaggtcggcaagaaggagggcggcgccatgtacgccgacgacaccgccgggtgggacacgcggatcaccctggaggacctgaagaacgaggagatggtgaccaaccacatgaagggcgagcacaagaagctcgcggaggccatcttcaagctgacctaccagaacaaggtggtccgcgtgcagcggccgacgccccgcggcaccgtgatggacatcatcagccggcgcgaccagcgcgggtccggccaggtcgggacctacggcctgaacaccttcacgaacatggaggcccagctcatccggcagatggagggcgaggggatcttcaagagcatccagcacctgaccgccaccgaggagatcgccgtgcagaactggctggcgcgcgtgggccgggagcgcctctcccggatggccatcagcggggacgactgcgtcgtgaagcccatcgacgaccgcttcgcctccgccctgaccgccctgaacgacatgggcaaggtgcggaaggacatccagcagtgggagcccagccgcgggtggaacgactggacgcaggtcccgttctgctcccaccacttccacgagctcgtgatgaaggacggccgggtgctggtcgtgccctgccgcaaccaggacgagctgatcggccgggcgcgcatcagccagggggccggctggtccctcaaggagaccgcctgcctgggcaagagctacgcccagatgtggaccctgatgtacttccaccggcgcgacctccggctggccgcgaacgccatctgctccgccgtgcccagccactgggtccccacctcccgcaccacgtggagcatccacgccaagcacgagtggatgaccaccgaggacatgctggcggtgtggaaccgggtgtggatccaggagaacccgtggatggaggacaagacccccgtcgagtcctgggaggaggtgccctacctcggcaagcgcgaggaccagtggtgcgggagcctgatcggcctgacgagccgggccacctgggccaagaacatccagaccgccatcaaccaggtgcgctccctcatcggcaacgaggagtacaccgactacatgcccagcatgaagcgcttccggcgcgaggaggaggaggccggggtcctgtggtga

SEQ ID NO: 9798 - RNA, 9876 nt, synthetic construct
  misc_feature 1..9876: note = derived and/or modified CDS sequence (opt1) from DENV-2__AF208496__SS-prME
  source 1..9876: mol_type = other RNA
accgccggcgtgatcgtcatgctgatccccaccgccatggcgttccacctcaccacccggaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccttcctccggcagaacgagcccgaggacatcgactgctggtgcaacttcacctccacctgggtcacctacgggacctgcaccaccacgggcgagcaccggcgcgagaagcggagcgtggccctggtgccccacgtcgggatgggcctggagacccggaccgagacctggatgtccagcgagggggcctggaagcacgtgcagcggatcgagacgtggatcctccgccacccgggcttcaccatcatggccgcgatcctggcctacaccatcgggaccacgcacttccagcgggccctgatcttcatcctcctgaccgccgtggcgccctccatgaccatgcggtgcatcggcatctccaaccgggacttcgtcgagggcgtgtccgggggcagctgggtggacatcgtcctggagcacgggtcctgcgtgaccacgatggccaagaacaagcccaccctcgacttcgagctgatcaagaccgaggccaagcagcccgccaccctgcgcaagtactgcatcgaggccaagctcacgaacaccaccaccgagagccggtgcccgacgcagggcgagccctccctgaacgaggagcaggacaagcgcttcatctgcaagcacagcatggtggaccggggctgggggaacggctgcgggctgttcggcaagggcgggatcgtgacctgcgcgatgttcacgtgcaagaagaacatggagggcaaggtggtgcagcccgagaacctcgagtacaccatcgtcatcacgccccactccggggaggagcacgccgtgggcaacgacaccgggaagcacggcaaggagatcaagatcaccccgcagagctccatcaccgaggccgagctgaccgggtacggcacggtgaccatggagtgcagcccccgcaccggcctggacttcaacgagatggtcctcctgcagatggaggacaaggcctggctggtgcaccggcagtggttcctcgacctgcccctgccctggctcccgggggccgacacccagggctccaactggatccagaaggagacgctggtgaccttcaagaacccccacgcgaagaagcaggacgtcgtggtcctggggagccaggagggcgccatgcacaccgccctcaccggggccacggagatccagatgtccagcggcaacctgctgttcaccggccacctcaagtgccgcctgcggatggacaagctgcagctcaaggggatgagctactccatgtgcaccggcaagttcaagatcgtgaaggagatcgccgagacccagcacgggacgatcgtgatccgcgtccagtacgagggcgacggcagcccctgcaagatccccttcgagatcaccgacctggagaagcggcacgtgctggggcgcctcatcaccgtgaacccgatcgtcaccgagaaggactcccccgtgaacatcgaggcggagccgcccttcggcgacagctacatcatcatcggggtggagccgggccagctgaagctgaactggttcaagaaggggtccagcatcggccagatgttcgagacgaccatgcgcggcgccaagcggatggccatcctcggggacaccgcctgggacttcggctccctcggcggggtcttcaccagcatcgggaaggccctgcaccaggtgttcggggcgatctacggcgccgccttctccggggtgagctggacgatgaagatcctcatcggcgtcatcatcacctggatcgggatgaactcccgcagcacctccctgagcgtgtccctggtgctggtcggcgtggtgaccctctacctgggggccatggtccaggcggacagcggctgcgtggtgtcctggaagaacaaggagctgaagtgcggcagcgggatcttcatcacggacaacgtccacacctggaccgagcagtacaagttccagcccgagtcccccagcaagctcgccagcgccatccagaaggcccacgaggagggcatctgcgggatccggtccgtgacccgcctggagaacctgatgtggaagcagatcacgcccgagctcaaccacatcctgagcgagaacgaggtgaagctgaccatcatgaccggcgacatcaaggggatcatgcaggccggcaagcggtccctccgcccgcagcccaccgagctgaagtacagctggaagacgtggggcaaggcgaagatgctgtccaccgagagccacaaccagaccttcctcatcgacgggcccgagaccgccgagtgcccgaacacgaaccgggcctggaactccctggaggtcgaggactacggcttcggggtgttcaccaccaacatctggctgaagctccgcgagaagcaggacgtgttctgcgacagcaagctgatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctctggagcaacggcgtgctggagtccgagatgatcatccccaagaacttcgccgggcccgtgagccagcacaactaccgcccgggctaccacacgcagaccgcggggccctggcacctgggcaagctcgagatggacttcgacttctgcgaggggaccaccgtggtggtcacggaggactgcggcaaccggggcccctccctgcgcaccaccaccgccagcgggaagctgatcacggagtggtgctgccggagctgcaccctgccgcccctgcgctaccggggcgaggacgggtgctggtacggcatggagatccgccccctgaaggagaaggaggagaacctcgtgaactccctggtgaccgccgggcacggccagatcgacaacttcagcctgggcgtcctcgggatggccctgttcctggaggagatgctccggacccgcgtgggcacgaagcacgcgatcctgctggtggccgtctccttcgtgaccctcatcaccgggaacatgagcttccgggacctgggccgcgtgatggtcatggtgggggccaccatgacggacgacatcggcatgggcgtgacctacctggccctcctggccgcgttcaaggtccgccccaccttcgccgccgggctgctcctgcggaagctgacctccaaggagctcatgatggccacgatcggcatcgccctgctgagccagtccaccatgcccgagaccatcctcgagctgaccgacgcgctggccctcgggatgatggtgctgaagatcgtgcgcaacatggagaagtaccagctggccgtcacgatcatggccatcagctgcgtgcccaacgccgtgatcctccagaacgcgtggaaggtctcctgcaccatcctggccgccgtgagcgtcagccccctgctcctgaccagctcccagcagaaggccgactggatccccctggcgctcaccatcaagggcctgaaccccacggccatcttcctgaccaccctcagccggacctccaagaagcgcagctggccgctgaacgaggccatcatggccgtgggcatggtgtccatcctggccagctccctcctgaagaacgacatccccatgacggggcccctggtcgcgggcgggctcctgaccgtgtgctacgtgctgaccggccggagcgccgacctcgagctggagcgcgccgccgacgtcaagtgggaggaccaggccgagatcagcgggtccagccccatcctgtccatcaccatcagcgaggacggctccatgagcatcaagaacgaggaggaggagcagacgctcaccatcctgatccggaccggcctgctcgtgatctccggggtgttcccggtcagcatccccatcaccgcggccgcctggtacctgtgggaggtgaagaagcagcgcgccggcgtgctgtgggacgtccccagcccgccgcccgtggggaaggccgagctcgaggacggcgcgtaccggatcaagcagcgcgggatcctgggctacagccagatcggcgccggggtgtacaaggagggcaccttccacacgatgtggcacgtcacccgcggggccgtgctgatgcaccgcggcaagcggatcgagccctcctgggccgacgtgaagaaggacctcatcagctacgggggcggctggaagctggagggggagtggaaggagggcgaggaggtccaggtgctggccctcgagcccgggaagaacccccgcgcggtgcagaccaagcccggcatcttcaagaccaacacggggaccatcggcgccgtctccctggacttcagccccggcacctccgggagccccatcgtggaccggaagggcaaggtggtcgggctgtacggcaacggcgtggtgacccgctccggggcctacgtcagcgccatcgcgcagacggagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctccgcaccctgatcctggccccgacgcgcgtggtcgcggccgagatggaggaggccctgcgggggctccccatccgctaccagacccccgccatccgggccgagcacaccggccgcgagatcgtggacctgatgtgccacgcgaccttcacgatgcggctgctcagccccgtgcgcgtcccgaactacaacctgatcatcatggacgaggcccacttcaccgaccccgccagcatcgccgcccggggctacatctccacccgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgaccgacttcaaggggaagaccgtctggttcgtgccgagcatcaaggcgggcaacgacatcgccgcctgcctgcgcaagaacggcaagaaggtgatccagctctcccggaagaccttcgacagcgagtacgtcaagacgcgcgccaacgactgggacttcgtggtgaccaccgacatctccgagatgggggccaacttcaaggcggagcgggtcatcgacccccgccggtgcatgaagcccgtgatcctgaccgacggcgaggagcgcgtgatcctggccgggcccatgccggtcacgcacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccatcgacggggagtaccggctccgcggcgaggcccggaagaccttcgtggacctgatgcgccgcggggacctgcccgtctggctcgcctacaaggtggccgcggagggcatcaactacgccgaccgcaagtggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcacgctgaacctgatcaccgagatggggcggctccccaccttcatgacccagaaggcccgcaacgccctggacaacctggccgtgctccacacggcggaggccggcgggcgggcctacaaccacgccctgtccgagctgcccgagaccctcgagaccctgctgctcctgaccctgctcgccacggtcaccggcggcatcttcctgttcctgatgagcgggaagggcatcgggaagatgaccctcggcatgtgctgcatcatcaccgcgtccagcctgctgtggtacgcccagatccagccgcactggatcgccgcctccatcatcctcgagttcttcctgatcgtgctgctcatccccgagcccgagaagcagcgcacgccccaggacaaccagctgacgtacgtggtcatcgccatcctgaccgtggtggcggccaccatggccaacgagatggggttcctcgagaagaccaagaaggacctgggcctgggcagcatcgccacgcaggagagcgagtccaacatcctcgacatcgacctgcggccggccagcgcgtggaccctgtacgccgtcgccaccaccttcgtgacgcccatgctccgccactccatcgagaacagctccgtgaacgtcagcctgaccgccatcgcgaaccaggccaccgtgctgatggggctcggcaaggggtggcccctgtccaagatggacatcggcgtgcccctgctcgccatcgggtgctacagccaggtcaacccgatcaccctgacggccgccctgctcctgctggtggcgcactacgccatcatcggccccggcctccaggccaaggccacccgggaggcccagaagcgcgcggccgccgggatcatgaagaaccccaccgtggacggcatcaccgtcatcgacctggagcccatcccgtacgaccccaagttcgagaagcagctggggcaggtcatgctcctgatcctgtgcgtgacgcaggtcctcatgatgcggaccacctgggccctgtgcgaggccctgaccctcgcgacgggccccatctccaccctgtgggaggggaaccccggccgcttctggaacaccaccatcgccgtgagcatggccaacatcttccgcggctcctacctggccggggcgggcctcctgttcagcatcatgaagaacacgaccaacacccggcgcgggaccggcaacatcggcgagacgctgggggagaagtggaagtcccggctcaacgccctgggcaagagcgagttccagatctacaagaagtccgggatccaggaggtggaccgcaccctggccaaggagggcatcaagcgcggggagaccgaccaccacgccgtcagccgcggctccgccaagctccggtggttcgtggagcgcaacatggtgaccccggagggcaaggtcgtggacctggggtgcggccgcgggggctggagctactactgcgggggcctgaagaacgtgcgcgaggtcaagggcctcacgaagggcggccccgggcacgaggagcccatccccatgtccacctacggctggaacctggtgcggctgcagagcggggtggacgtcttcttcaccccgcccgagaagtgcgacaccctcctgtgcgacatcggcgagagctcccccaaccccacgatcgaggcgggccgcaccctgcgggtgctcaacctggtggagaactggctgaacaacaacacccagttctgcatcaaggtcctcaacccgtacatgcccagcgtgatcgagaagatggagaccctgcagcgcaagtacgggggcgccctggtgcggaaccccctctcccgcaacagcacccacgagatgtactgggtctccaacgccacggggaacatcgtgagctccgtgaacatgatcagccggatgctgatcaaccgcttcaccatgaagcacaagaaggccacctacgagccggacgtcgacctgggctccgggacccggaacatcggcatcgagagcgagatccccaacctggacatcatcggcaagcgcatcgagaagatcaagcaggagcacgagacgtcctggcactacgaccaggaccacccctacaagacctgggcctaccacgggagctacgagaccaagcagaccggctccgcgagctccatggtgaacggggtggtccgcctcctgacgaagccctgggacgtggtgccgatggtcacccagatggccatgaccgacaccacgcccttcggccagcagcgggtgttcaaggagaaggtggacacccgcacccaggagcccaaggagggcaccaagaagctgatgaagatcacggccgagtggctctggaaggagctggggaagaagaagacgccccggatgtgcacccgcgaggagttcacccggaaggtccgcagcaacgccgccctgggcgcgatcttcacggacgagaacaagtggaagtccgcccgggaggccgtggaggacgggcgcttctgggagctcgtggaccgggagcgcaacctgcacctggagggcaagtgcgagacctgcgtctacaacatgatggggaagcgggagaagaagctcggcgagttcggcaaggccaaggggagccgcgcgatctggtacatgtggctgggcgcccggttcctggagttcgaggccctcgggttcctgaacgaggaccactggttctcccgcggcaacagcctgagcggggtggagggcgagggcctccaccggctggggtacatcctgcgcgaggtcggcaagaaggagggcggcgccatgtacgccgacgacaccgcggggtgggacacccggatcacgctcgaggacctgaagaacgaggagatggtgaccaaccacatgaagggcgagcacaagaagctggccgaggccatcttcaagctcacctaccagaacaaggtggtccgcgtgcagcggccgacgccccgcggcaccgtgatggacatcatctcccggcgcgaccagcgcgggagcggccaggtcgggacctacggcctgaacaccttcaccaacatggaggcccagctgatccggcagatggagggcgaggggatcttcaagtccatccagcacctcacggccaccgaggagatcgcggtgcagaactggctggcccgcgtgggccgggagcgcctgagccggatggccatctccggggacgactgcgtcgtgaagcccatcgacgaccgcttcgccagcgccctcaccgcgctgaacgacatgggcaaggtgcggaaggacatccagcagtgggagccctcccgcgggtggaacgactggacccaggtcccgttctgcagccaccacttccacgagctggtgatgaaggacggccgggtgctcgtcgtgccctgccgcaaccaggacgagctgatcggccgggcccgcatctcccagggggccggctggagcctgaaggagacggcctgcctcgggaagtcctacgcccagatgtggaccctgatgtacttccacaagcgggacctgcgcctcgcggccaacgccatctgcagcgccgtgccctcccactgggtccccaccagccggaccacctggtccatccacgcgaagcacgagtggatgacgaccgaggacatgctggccgtgtggaaccgcgtgtggatccaggagaacccgtggatggaggacaagacccccgtcgagagctgggaggaggtgccctacctgggcaagcgggaggaccagtggtgcgggtccctcatcggcctgaccagccgcgccacgtgggccaagaacatccagaccgccatcaaccaggtgcggagcctgatcggcaacgaggagtacaccgactacatgccctccatgaagcgcttccgccgggaggaggaggaggcgggggtcctctggtga

SEQ ID NO: 9799 - RNA, 9876 nt, synthetic construct
  misc_feature 1..9876: note = derived and/or modified CDS sequence (opt1) from DENV-2__AY702040__SS-prME
  source 1..9876: mol_type = other RNA
accgcgggcatgatcatcatgctgatccccaccgtgatggccttccacctcaccacccggaacggggagccccacatgatcgtgagccggcaggagaagggcaagagcctgctgttcaagaccaaggacgggaccaacatgtgcaccctcatggcgatggacctgggcgagctgtgcgaggacaccatcacctacaagtgccccttcctcaagcagaacgagcccgaggacatcgactgctggtgcaacagcacctccacgtgggtgacctacgggacctgcaccacgaccggcgagcaccgccgggagaagcgcagcgtggccctggtcccccacgtgggcatggggctggagacccggaccgagacgtggatgtccagcgagggcgcctggaagcacgcccagcgcatcgagacctggatcctccggcaccccgggttcaccatcatggccgcgatcctggcctacaccatcggcacgacccacttccagcgcgtgctgatcttcatcctcctgaccgccatcgccccctccatgaccatgcggtgcatcgggatcagcaaccgcgacttcgtcgagggcgtgtccggcgggagctgggtggacatcgtcctggagcacggctcctgcgtgacgaccatggcgaagaacaagcccaccctcgacttcgagctgatcaagaccgaggccaagcagcccgccacgctgcggaagtactgcatcgaggccaagctcaccaacaccaccacggacagccgctgcccgacccagggggagcccaccctgaacgaggagcaggacaagcggttcgtgtgcaagcactccatggtcgaccgcggctggggcaacgggtgcggcctgttcgggaagggcgggatcgtgacctgcgccatgttcacgtgcaagaagaacatggagggcaagatcgtgcagcccgagaacctcgagtacaccgtcgtgatcacgccccacagcggcgaggagcacgcggtggggaacgacaccggcaagcacgggaaggaggtcaagatcaccccgcagtccagcatcacggaggccgagctgaccggctacgggaccgtgaccatggagtgcagcccccggacgggcctggacttcaacgagatggtgctcctgcagatggaggacaaggcctggctggtccaccgccagtggttcctcgacctgcccctgccctggctcccgggcgccgacacccaggggagcaactggatccagaaggagaccctggtgaccttcaagaacccccacgccaagaagcaggacgtggtcgtgctgggctcccaggagggggcgatgcacacggccctcaccggcgccaccgagatccagatgagcagcgggaacctgctgttcaccggccacctcaagtgccggctgcgcatggacaagctgcagctcaagggcatgtcctacagcatgtgcacggggaagttcaagatcgtcaaggagatcgccgagacccagcacggcaccatcgtgatccgggtgcagtacgagggggacggctccccctgcaagatccccttcgagatcatggacctggagaagcgccacgtcctgggccggctcatcaccgtgaacccgatcgtgacggagaaggacagccccgtcaacatcgaggccgagccgcccttcggggactcctacatcatcatcggcgtggagccggggcagctgaagctggactggttcaagaagggcagctccatcgggcagatgttcgagaccaccatgcgcggcgcgaagcgcatggccatcctcggcgacaccgcctgggacttcgggagcctgggcggggtgttcacgtccatcggcaaggccctgcaccaggtcttcggggccatctacggcgcggccttcagcggcgtgtcctggaccatgaagatcctcatcggggtgatcatcacctggatcggcatgaacagccggtccaccagcctgtccgtcagcctggtgctggtggggatcgtcacgctctacctgggcgtgatggtgcaggccgactccgggtgcgtcgtgagctggaagaacaaggagctgaagtgcggctccggcatcttcgtgaccgacaacgtccacacctggaccgagcagtacaagttccagcccgagagccccagcaagctcgcctccgcgatccagaaggcccacgaggaggggatctgcggcatccgcagcgtgacgcggctggagaacctgatgtggaagcagatcacctccgagctcaaccacatcctgagcgagaacgaggtgaagctgaccatcatgaccggggacatcaagggcatcatgcaggtcgggaagcgctccctccggccccagccgacggagctgcgctacagctggaagacctggggcaaggccaagatgctgtccaccgagctccacaaccagaccttcctgatcgacggccccgagacggccgagtgccccaacaccaaccgggcctggaacagcctggaggtggaggactacgggttcggcgtgttcaccaccaacatctggctccgcctgcgggagaagcaggacgcgttctgcgacccgaagctgatgtccgccgccatcaaggacaaccgcgccgtccacgccgacatggggtactggatcgagagcgcgctcaacgacacctggaagatcgagaaggcctccttcatcgaggtgaagtcctgccactggcccaagtcccacacgctgtggagcaacggcgtgctggagtccgagatggtcatccccaagaacttcgccggccccgtgagccagcacaacaaccggccggggtaccacacccagaccgccggcccctggcacctcgggaagctggagatggacttcgacttctgcgagggcaccacggtggtcgtgaccgaggagtgcgggaaccgcggcccctccctgcggaccaccacggccagcggcaagctcatcaccgagtggtgctgccgcagctgcaccctgcccccgctgcggtaccgcggggaggacggctgctggtacgggatggagatccggcccctcaaggagaaggaggagaacctggtgtccagcctggtcaccgcgggccacgggcagatcgacaacttctccctcggcatcctgggcatggccctgttcctcgaggagatgctgcgcacgcgggtggggaccaagcacgccatcctgctcgtggccgtcagcttcgtgaccctgatcaccggcaacatgtccttccgcgacctggggcgcgtgatggtcatggtgggcgcgacgatgaccgacgacatcgggatgggcgtgacctacctcgccctgctggccgccttcaaggtccggcccaccttcgccgcgggcctcctgctgcgcaagctcacgagcaaggagctgatgatgaccaccatcgggatcgtgctgctctcccagagctccatccccgagaccatcctggagctgacggacgccctcgccctgggcatgatggtgctgaagatggtccggaacatggagaagtaccagctcgccgtgaccatcatggccatcctgtgcgtgccgaacgcggtcatcctgcagaacgcctggaaggtgagctgcaccatcctcgccgtcgtgtccgtgagccccctgctgctcacctccagccagcagaaggccgactggatccccctggccctgacgatcaaggggctcaaccccaccgcgatcttcctgaccaccctgtcccgcacgagcaagaagcggtcctggccgctcaacgaggccatcatggccgtcggcatggtgagcatcctggcctccagcctgctcaagaacgacatccccatgaccggccccctggtggccggcgggctgctcaccgtctgctacgtgctgaccgggcgcagcgccgacctggagctcgagcgggccacggacgtgaagtgggacgaccaggccgagatctccgggagctcccccatcctgagcatcatcatctccgaggacgggagcatgtccatcaagaacgaggaggaggagcagaccctgaccatcctcatccgcaccggcctgctggtcatcagcggcctcttcccggtgtccatccccatcaccgccgcggcctggtacctgtgggaggtgaagaagcagcgggccggggtcctgtgggacgtgcccagcccgccgcccgtgggccgcgccgagctcgaggacggggcctaccggatcaagcagaagggcatcctggggtactcccagatcggcgcgggcgtctacaaggaggggacgttccacaccatgtggcacgtgacccgcggcgccgtgctgatgcacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagaccaagcccgggctgttccggacgaacaccggcaccatcggggcggtgagcctggacttctcccccggcaccagcggctcccccatcgtggacaagaaggggaaggtcgtgggcctctacgggaacggcgtggtcacgcgcggcggggcctacgtgagcgccatcgcccagaccgagaagtccatcgaggacaaccccgagatcgaggacgacatcttccggaagcgccggctgaccatcatggacctgcaccccggcgccgggaagaccaagcgctacctgcccgcgatcgtgcgggaggccatcaagcgcggcctccgcacgctgatcctggccccgacccgggtcgtggccgcggagatggaggaggccctccgcgggctgcccatccggtaccagacccccgccatccgcgccgagcacaccggccgggagatcgtggacctgatgtgccacgccacgttcaccatgcgcctcctgagccccatccgggtcccgaactacaacctgatcatcatggacgaggcgcacttcaccgaccccgccagcatcgccgcccgcggctacatctccacccgggtggagatgggggaggccgcgggcatcttcatgacggccacgccgcccgggagccgcgacccgttcccccagtccaacgcccccatcatggacgaggagcgggagatccccgagcgcagctggaactccggccacgagtgggtgaccgacttcaaggggaagaccgtctggttcgtgccgagcatcaagacgggcaacgacatcgccgcctgcctccggaagaacggcaagcgcgtgatccagctgtcccggaagaccttcgacagcgagtacgtcaagacccgcaccaacgactgggacttcgtggtgacgaccgacatctccgagatgggggcgaacttcaaggccgagcgggtcatcgacccccgccggtgcatgaagcccgtgatcctgaccgacggcgaggagcgcgtgatcctcgccgggcccatgccggtcacccacagctccgccgcgcagcgccggggccgcatcgggcggaacccccgcaacgagaacgaccagtacatctacatgggcgagcccctggagaacgacgaggactgcgcccactggaaggaggccaagatgctgctcgacaacatcaacacgcccgagggcatcatcccgagcatgttcgagcccgagcgggagaaggtggacgccatcgacggggagtaccgcctgcggggcgaggcccgcaagaccttcgtggacctgatgcggcgcggggacctccccgtctggctggcgtacaaggtggccgccgagggcatcaactacgccgaccggcgctggtgcttcgacgggacccggaacaaccagatcctggaggagaacgtggaggtcgagatctggaccaaggagggcgagcgcaagaagctcaagccgcggtggctggacgcccgcatctactccgaccccctggcgctcaaggagttcaaggagttcgccgccggccgcaagagcctgacgctgaacctcatcaccgagatggggcgcctgcccaccttcatgacccagaaggcccgggacgccctggacaacctcgcggtgctgcacacggccgaggccggcgggaaggcctacaaccacgcgctgtccgagctccccgagaccctggagaccctgctcctgctgaccctcctggccaccgtcacgggcggcatcttcctgttcctcatgagcgggcgcggcatcgggaagatgaccctgggcatgtgctgcatcatcaccgcctccatcctgctctggtacgcccagatccagccgcactggatcgccgcgagcatcatcctggagttcttcctgatcgtgctcctgatccccgagcccgagaagcagcggacgccccaggacaaccagctgacgtacgtgatcatcgccatcctcaccgtcgtggccgccaccatggccaacgagatggggttcctggagaagaccaagaaggacttcggcctgggccacatcgcgacgcagcagccggagtccaacatcctcgacatcgacctgcgccccgccagcgcctggaccctgtacgccgtggccaccaccttcatcacgcccatgctccgccacagcatcgagaactccagcgtcaacgtgtccctgaccgcgatcgccaaccaggccaccgtgctgatggggctcggcaaggggtggcccctgagcaagatggacatcggcgtcccgctgctcgccatcgggtgctactcccaggtgaaccccatcaccctgacggccgcgctgctcctgctggtggcccactacgccatcatcggccccggcctccaggccaaggcgacccgggaggcccagaagcgcgccgccgccgggatcatgaagaaccccaccgtcgacggcatcaccgtgatcgacctggacccgatcccctacgaccccaagttcgagaagcagctgggccaggtgatgctcctggtcctgtgcgtgacccaggtgctcatgatgcggaccacctgggcgctgtgcgaggccctgaccctcgccacgggccccgtcagcaccctgtgggaggggaacccgggccgcttctggaacaccaccatcgccgtgtccatggccaacatcttccggggcagctacctggcgggggccggcctcctgttctccatcatgaagaacacgaccagcgcccgccgggggaccggcaacatgggcgagaccctgggggagaagtggaagtcccgcctcaacgccctgggcaagagcgagttccagatctacaagaagtccgggatccaggaggtggaccggacgctggccaaggagggcatcaagcgcggggagaccgaccaccacgcggtcagccggggctccgccaagctccgctggttcgtggagcggaacctggtgacccccgagggcaaggtcgtggacctggggtgcggccgcgggggctggagctactactgcgggggcctcaagaacgtgcgggaggtcaagggcctgaccaagggcgggcccgggcacgaggagcccatcccgatgtccacgtacggctggaacctggtgcgcctccagagcggggtggacgtcttcttcgtgccgcccgagaagtgcgacaccctgctgtgcgacatcggcgagtccagccccaacccgaccgtggaggccggccggaccctccgcgtcctgaacctggtggagaactggctcaacaacaacacccagttctgcgtgaaggtcctgaacccctacatgcccagcgtgatcgagcggatggagacgctgcagcgcaagtacgggggcgccctggtgcgcaacccgctctcccggaacagcacccacgagatgtactgggtctccaacgcgagcgggaacatcgtgtccagcgtgaacatgatctcccgcatgctgatcaaccggttcaccatgcgccacaagaaggccacctacgagcccgacgtcgacctgggcagcgggacgcggaacatcggcatcgagtccgagacccccaacctcgacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtggtccggctgctgaccaagccgtgggacgtgatccccatggtgacccagatggccatgacggacaccacccccttcggccagcagcgcgtcttcaaggagaaggtggacacccggacgcaggagcccaaggagggcaccaagaagctcatgaagatcaccgcggagtggctgtggaaggagctggggaagaagaagaccccgcgcatgtgcacgcgggaggagttcaccaagaaggtgcgctccaacgccgccctcggcgccatcttcaccgacgagaacaagtggaagtccgcccgggaggcggtcgaggacaaccgcttctgggagctggtggacaaggagcggaacctgcacctcgaggggaagtgcgagacctgcgtctacaacatgatgggcaagcgcgagaagaagctgggggagttcggcaaggccaagggctcccgggccatctggtacatgtggctgggggcccgcttcctcgagttcgaggccctgggcttcctgaacgaggaccactggttcagccgggagaactccctcagcggggtggagggcgaggggctgcacaagctgggctacatcctccgcgaggtgagcaagaaggagggcggggcgatgtacgccgacgacacggccggctgggacacccggatcaccatcgaggacctgaagaacgaggagatgatcaccaaccacatggccggggagcacaagaagctggcggaggccatcttcaagctcacgtaccagaacaaggtcgtgcgcgtgcagcgccccacgccccggggcaccgtcatggacatcatctcccgcaaggaccagcgggggagcggccaggtgggcacctacgggctgaacacgttcaccaacatggaggcccagctgatccgccagatggagggcgaggggatcttcaagtccatccagcacctcaccgccagcgaggagatcgccgtgcaggactggctggtccgggtgggccgcgagcggctgtcccgcatggcgatcagcggcgacgactgcgtggtcaagcccctcgacgaccggttcgccaaggccctgaccgccctgaacgacatggggaaggtgcgcaaggacatccagcagtgggagccgtcccggggctggaacgactggacccaggtgcccttctgcagccaccacttccacgagctcatcatgaaggacgggcgcaccctggtcgtgccctgccggaaccaggacgagctgatcggccgcgcccggatctcccagggggcgggctggagcctccgcgagaccgcctgcctgggcaagtcctacgcccagatgtggagcctgatgtacttccaccggcgcgacctccggctggccgccaacgcgatctgctccgccgtgcccagccactgggtcccgacctcccgcaccacgtggagcatccacgcctcccacgagtggatgaccaccgaggacatgctgaccgtgtggaaccgcgtgtggatcctcgagaacccctggatggaggacaagacgcccgtcgagagctgggaggagatcccctacctggggaagcgggaggaccagtggtgcggcagcctgatcgggctcacctcccgcgccacctgggccaagaacatccagaccgcgatcaaccaggtgcggagcctgatcggcaacgaggagtacacggactacatgccgtccatgaagcgcttccggcgcgaggaggaggaggccggggtgctgtggtga

SEQ ID NO: 9800 - RNA, 9876 nt, synthetic construct
  misc_feature 1..9876: note = derived and/or modified CDS sequence (opt1) from DENV-2__AY037116__SS-prME
  source 1..9876: mol_type = other RNA
accgccggcatcatcatcatgatgatccccaccgtgatggccttccacctgaccacccgcaacggggagccccacatgatcgtcagccggcaggagaagggcaagagcctcctgttcaagaccgagaacggggtgaacatgtgcaccctgatggcgatggacctcggcgagctgtgcgaggacaccatcacctacaactgccccctgctccgccagaacgagcccgaggacatcgactgcgggtgccacagcaccagcacctgggtgacctacgggacctgcaccgccaccggcgagcaccggcgcgagaagcggagcgtcgccctggtgccccacgtggggatgggcctggagacgcgcaccgagacctggatgtccagcgagggggcctggaagcacgcccagcggatcgagacctgggtcctccgccaccccggcttcacgatcatggcggccatcctggcctacaccatcgggaccacctacttccagcgggtgctgatcttcatcctcctgacggccgtgaccccctccatgaccatgcgctgcatcggcatcagcaaccgggacttcgtcgagggcgtgtccgggggcagctgggtggacatcgtcctggagcacgggtcctgcgtgaccacgatggcgaagaacaagcccaccctcgacttcgagctggtgaagaccgaggccaagcaccccgccaccctgcgcaagtactgcatcgaggccaagctcacgaacaccaccaccgccagccggtgcccgacgcagggcgagccctccctgaacgaggagcaggacaagcgcttcgtctgcaagcacagcatggtggaccggggctgggggaacggctgcgggctgttcggcaagggcgggatcgtgacctgcgcgatgttcacgtgcaagaagaacatggagggcaaggtcgtgcagcccgagaacctcgagtacaccatcgtgatcacgccccactccggggaggagaacgccgtcggcaacgacaccgggaagcacggcaaggagatcaaggtgaccccgcagagctccatcaccgaggccgagctgaccgggtacggcacggtgaccatggagtgcagcccccgcaccggcctggacttcaacgagatggtcctcctgcagatggagaacaaggcctggctggtgcaccggcagtggttcctcgacctgcccctgccctggctcccgggggccgacacccagggctccaactggatccagaaggagacgctggtcaccttcaagaacccccacgcgaagaagcaggacgtggtggtcctggggagccaggagggcgccatgcacaccgccctcaccggggccacggagatccagatgagctccggcaacctgctgttcaccggccacctcaagtgccgcctgcggatggacaagctgcagctcaaggggatgagctactccatgtgcaccggcaagttcaaggtggtgaaggagatcgccgagacccagcacgggacgatcgtcatccgcgtgcagtacgagggcgacggcagcccctgcaagatccccttcgagatcatggacctggagaagcggcacgtgctggggcgcctcatcaccgtcaacccgatcgtgaccgagaaggactcccccgtgaacatcgaggcggagccgcccttcggcgacagctacatcatcatcggggtcgagccgggccagctgaagctgtcctggttcaagaaggggagctccatcggccagatgttcgagaccacgatgcgcggcgccaagcggatggccatcctcggggacaccgcctgggacttcggcagcctcggcggggtgttcacctccatcgggaaggccctgcaccaggtgttcggggcgatctacggcgccgccttcagcggggtctcctggaccatgaagatcctcatcggcgtggtgatcacgtggatcgggatgaacagccgctccaccagcctgtccgtcagcctggtgctggtgggcgtcgtgaccctctacctgggggtgatggtccaggccgactccggctgcgtggtgagctggaagaacaaggagctgaagtgcggcagcgggatcttcatcaccgacaacgtccacacgtggaccgagcagtacaagttccagcccgagtcccccagcaagctcgcgtccgccatccagaaggcccacgaggagggcatctgcgggatccggagcgtgacccgcctggagaacctgatgtggaagcagatcacccccgagctcaaccacatcctgtccgagaacgaggtgaagctgacgatcatgaccggcgacatcaaggggatcatgcaggccggcaagcggagcctccgcccgcagcccaccgagctgaagtactcctggaaggcctggggcaaggcgaagatgctgagcaccgagctccacaaccacacgttcctgatcgacgggcccgagaccgccgagtgcccgaacaccaaccgggcctggaactccctggaggtcgaggactacggcttcggggtgttcaccacgaacatctggctcaagctgaaggagcgccaggacgtgttctgcgacagcaagctgatgtccgccgccatcaaggacaaccgggcggtccacgccgacatgggctactggatcgagagcgccctcaacgacacctggaagatcgagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagaccgcggggccctggcacctcggccggctggagatggacttcgacttctgcgaggggacgaccgtggtggtcaccgaggactgcggcaaccgcggccccagcctgcggaccacgaccgcctccgggaagctcatcaccgagtggtgctgccgcagctgcaccctgcccccgctgcggtaccgcggcgaggacgggtgctggtacggcatggagatccggcccctcaaggagaaggaggagaacctggtgaactccctggtgacggccgggcacggccagatcgacaacttcagcctcggcgtcctggggatggccctgttcctcgaggagatgctgcgcacccgggtgggcaccaagcacgcgatcctgctcgtggccgtctccttcgtgaccctgatcacggggaacatgagcttccgcgacctgggccgcgtgatggtcatggtgggggccaccatgaccgacgacatcggcatgggcgtgacctacctcgccctgctggccgcgttcaaggtccggcccacgttcgccgccgggctcctgctgcgcaagctcacctccaaggagctgatgatgaccaccatcggcatcgtgctgctcagccagtccacgatccccgagaccatcctggagctgaccgacgcctgggccctcgggatgatggtcctgaagatcgtgcggaacatggagaagtaccagctggcggtgaccatcatggccatcctctgcgtcccgaacgccgtgatcctgcagaacgcctggaaggtgagctgcacgaccctggccgtcgtgtccgtgagccccctcctgctgacctccagccagcagaaggcggactggatccccctcgccctgaccatcaagggcctgaaccccacggccatcttcctcaccaccctgtcccgcaccagcaagaagcggtcctggccgctgaacgaggccatcatggcggtcggcatggtgagcatcctcgcctccagcctgctgaagaacgacatccccatgacggggcccctcgtggccggcgggctgctgaccgtctgctacgtgctcaccggccgcagcgccgacctggagctggagcgggccgcggacgtgcgctgggaggagcaggccgagatctccgggagctcccccatcctcagcatcaccatctccgaggacggcagcatgtccatcaagaacgaggaggaggagcagacgctgaccatcctgatccggaccggcctcctggtcatcagcgggctgttcccggcctccatccccatcaccgccgccgcgtggtacctctgggaggtgaagaagcagcgcgccggcgtgctgtgggacgtccccagcccgccgcccgtggggaaggccgagctggaggacggcgcctaccggatcaagcagaaggggatcctcggctactcccagatcggcgccggggtgtacaaggagggcaccttccacacgatgtggcacgtcacccgcggggcggtgctgatgcacaagggcaagcggatcgagcccagctgggccgacgtgaagaaggacctgatctcctacgggggcggctggaagctcgagggggagtggaaggagggcgaggaggtccaggtgctggccctggagcccgggaagaacccccgcgccgtgcagaccaagcccggcctcttcaagaccaacacggggaccatcggcgccgtcagcctggacttctcccccggcaccagcgggtcccccatcgtggacaagaagggcaaggtggtcgggctgtacggcaacggcgtggtgacccggagcggggcgtacgtctccgccatcgcccagacggagaagtccatcgaggacaaccccgagatcgaggacgacatcttccgcaagaagcggctcaccatcatggacctgcaccccggcgccgggaagaccaagcgctacctgcccgcgatcgtgcgggaggccatcaagcgcggcctgcggaccctcatcctggccccgacgcgcgtggtcgccgccgagatggaggaggcgctgcgcgggctccccatccggtaccagacccccgccatccgcgccgagcacaccggccgggagatcgtggacctgatgtgccacgccaccttcacgatgcgcctgctcagccccatccgggtgccgaactacaacctgatcatcatggacgaggcccacttcaccgaccccgcgtccatcgccgcccgcggctacatcagcacccgggtcgagatgggggaggccgccggcatcttcatgaccgcgacgccgcccgggtcccgcgacccgttcccccagagcaacgcccccatcatggacgaggagcgggagatccccgagcgctcctggaacagcggccacgagtgggtgaccgacttcaaggggaagaccgtgtggttcgtcccgtccatcaaggccggcaacgacatcgccgcgtgcctgcggaagaacggcaagaaggtgatccagctcagccgcaagaccttcgactccgagtacatcaagacgcggaccaacgactgggacttcgtggtcaccaccgacatcagcgagatgggggccaacttcaaggccgagcgcgtgatcgacccccggcgctgcatgaagcccgtgatcctgacggacggcgaggagcgggtcatcctggccgggcccatgccggtgacccactccagcgccgcgcagcgccggggccgcgtggggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtcgacgccatcgacggggagtaccgcctccggggcgaggcccgcaagaccttcgtggacctgatgcggcgcggggacctgcccgtctggctcgcgtaccgggtggccgccgagggcatcaactacgccgaccgccggtggtgcttcgacggggtgaagaacaaccagatcctggaggagaacgtcgaggtggagatctggacgaaggagggcgagcgcaagaagctgaagccgcggtggctcgacgcccgcatctacagcgaccccctggcgctgaaggagttcaaggagttcgccgccggccggaagtccctcaccctgaacctgatcaccgagatggggcgcctccccaccttcatgacgcagaaggcccggaacgcgctggacaacctggccgtgctccacaccgccgaggccggcgggcgcgcctacaaccacgcgctgagcgagctgcccgagaccctcgagaccctgctgctcctgacgctgctcgccaccgtcaccggcggcatcttcctgttcctgatgtccgggaagggcatcgggaagatgaccctcggcatgtgctgcatcatcaccgccagcatcctgctgtggtacgcccagatccagccgcactggatcgccgcgtccatcatcctcgagttcttcctgatcgtgctgctcatccccgagcccgagaagcagcggacgccccaggacaaccagctgacctacgtggtcatcgccatcctgaccgtggtggccgccaccatggccaacgagatggggttcctcgagaagacgaagaaggacttcggcctgggcagcatcgcgacccagcagccggagagcaacatcctggacatcgacctccgccccgcctccgcctggaccctgtacgccgtcgccaccacgttcatcacccccatgctgcggcacagcatcgagaactccagcgtgaacgtgtccctcaccgcgatcgccaaccaggccaccgtcctgatggggctgggcaaggggtggcccctcagcaagatggacatcggcgtgccgctgctggccatcgggtgctactcccaggtgaaccccatcacgctcaccgcggccctgctgctcctggtcgcccactacgccatcatcggccccggcctgcaggccaaggcgacccgcgaggcccagaagcgggccgccgccgggatcatgaagaaccccaccgtggacggcatcacggtgatcgacctcgacccgatcccctacgaccccaagttcgagaagcagctggggcaggtcatgctgctcgtgctgtgcgtgacccaggtcctgatgatgcgcaccacctgggcgctctgcgaggccctgacgctggccaccggccccatcagcaccctctgggaggggaacccgggccgcttctggaacaccacgatcgccgtgtccatggccaacatcttccggggcagctacctggcgggggccggcctgctgttctccatcatgaagaacaccgccaacacccgccgggggaccggcaacacgggcgagaccctgggggagaagtggaagaaccgcctgaacgccctcggcaagagcgagttccagatctacaagaagtccgggatccaggaggtggaccggaccctggcgaaggagggcatcaagcgcggggagaccgaccaccacgccgtcagccggggctccgccaagctgcgctggttcgtggagcggaacctcgtgacgcccgagggcaaggtcgtggacctggggtgcggccgcgggggctggagctactactgcgggggcctgaagaacgtgaaggaggtcaagggcctcaccaagggcggccccgggcacgaggagcccatcccgatgtccacctacggctggaacctggtgcggctgcagagcggggtggacgtcttcttcacgccgcccgagaagtgcgacacgctcctgtgcgacatcggcgagtccagccccaacccgaccgtggaggccggccgcaccctgcgggtgctcaacctggtcgagaactggctgaacaacaacacccagttctgcatcaaggtgctcaacccctacatgcccagcgtgatcgagaagatggaggccctgcagcgcaagtacgggggcgcgctggtccggaacccgctgtcccgcaacagcacccacgagatgtactgggtgtccaacgccagcgggaacatcgtgtccagcgtcaacatgatctcccggatgctcatcaaccgcttcacgatgcggcacaagaaggccacctacgagcccgacgtggacctgggcagcgggacccgcaacatcggcatcgagtccgagacccccaacctggacatcatcggcaagcgcatcgagaagatcaagcaggagcacgagacgagctggcactacgaccaggaccacccctacaagacctgggcctaccacgggtcctacgagaccaagcagaccggcagcgcctccagcatggtgaacggggtcgtgcggctcctgacgaagccgtgggacatcatccccatggtgacccagatggcgatgaccgacaccacgcccttcggccagcagcgcgtcttcaaggagaaggtggacacccggacccaggagcccaaggagggcaccaagaagctgatgaagatcacggccgagtggctctggaaggagctggggaagaagaagaccccgcgcatgtgcacccgggaggagttcacccgcaaggtccggtccaacgccgccctgggcgccatcttcacggacgagaacaagtggaagtccgcgcgcgaggccgtggaggactccgggttctgggagctcgtggacaaggagcggaacctgcacctggagggcaagtgcgagacctgcgtctacaacatgatggggaagcgcgagaagaagctcggcgagttcggcaaggccaaggggagccgggccatctggtacatgtggctgggcgcgcgcttcctggagttcgaggccctcgggttcctgaacgaggaccactggttctcccgggagaacagcctgagcggcgtggagggggagggcctccacaagctgggctacatcctgcgcgacgtgtccaagaaggagggcggcgccatgtacgccgacgacaccgccgggtgggacacccggatcacgctcgaggacctgaagaacgaggagatggtcaccaaccacatggagggcgagcacaagaagctggcggaggccatcttcaagctcacctaccagaacaaggtggtgcgcgtccagcggcccacgccccgcgggacggtgatggacatcatcagccggcgcgaccagcggggctccggccaggtggtcacctacgggctgaacaccttcaccaacatggaggcccagctgatccgccagatggagggcgagggggtgttcaagagcatccagcacctcacggtgaccgaggagatcgccgtcaagaactggctggtgcgcgtgggccgggagcgcctgtcccggatggccatcagcggcgacgactgcgtcgtgaagcccctcgacgaccgcttcgcgtccgccctgaccgccctgaacgacatggggaaggtgcggaaggacatccagcagtgggagccgagccgcggctggaacgactggacccaggtccccttctgctcccaccacttccacgagctcatcatgaaggacgggcgggtgctggtggtcccctgccgcaaccaggacgagctgatcggccgggcccgcatcagccagggggccggctggtccctccgggagacggcgtgcctgggcaagagctacgcccagatgtggtccctgatgtacttccaccgccgggacctccgcctggccgccaacgccatctgcagcgcggtgccctcccactgggtgccgaccagccggaccacctggtccatccacgccacccacgagtggatgacgaccgaggacatgctgaccgtctggaaccgcgtgtggatccaggagaacccctggatggaggacaagacccccgtggagagctgggaggagatcccctacctcgggaagcgggaggaccagtggtgcggcagcctgatcgggctgacgtcccgcgccacctgggccaagaacatccagaccgcgatcaaccaggtccggagcctcatcggcaacgaggagtacaccgactacatgccgtccatgaagcgcttccgccgggaggaggaggaggccggggtgctgtggtga

SEQ ID NO: 9801 - RNA, 9876 nt, synthetic construct
  misc_feature 1..9876: note = derived and/or modified CDS sequence (opt1) from DENV-2__AF169678__SS-prME
  source 1..9876: mol_type = other RNA
agcgcgggcatgatcatcatgctgatccccaccgtgatggccttccacctcaccacccggaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcaccccgggttcaccatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgcccgacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgcaagatccccttcgagatcatggacctggagaagcgctacgtgctcggccggctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcgcatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccggtccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccgcagcgtgacccggctggagaacctcatgtggaagcagatcacccccgagctgaaccacatcctggccgagaacgaggtcaagctcaccatcatgacgggggacatcaagggcatcatgcaggccgggaagcgctccctgcggccgcagcccaccgagctgaagtacagctggaagacctggggcaaggcgaagatgctctccaccgagagccacaaccagacgttcctgatcgacggccccgagaccgccgagtgcccgaacaccaaccgcgcctggaactccctggaggtggaggactacgggttcggcgtgttcaccacgaacatctggctcaagctgaaggagaagcaggacgccttctgcgacagcaagctgatgtccgccgcgatcaaggacaaccgggccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccgcccggggtaccacacccagatcgccggcccctggcacctggggaagctggagatggacttcgacttctgcgacggcaccacggtggtggtcaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctcttcctggaggagatgctgcggacgcgcgtggggaccaagcacgccatcctcctggtcgccgtgagcttcgtgaccctgatcaccggcaacatgtccttcaaggacctcgggcgggtcgtggtgatggtcggcgccacgatgaccgacgacatcgggatgggcgtgacctacctggccctgctcgcggccttcaaggtgcgccccaccttcgccgccggcctgctgctccggaagctgacgagcaaggagctgatgatgaccaccatcgggatcgtcctcctgtcccagagcaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcaccatcctggcggtggtcagcgtgagccccctgatcctcacgagctcccagcagaagaccgactggatccccctggccctgaccatcaaggggctcaaccccaccgccatcttcctgacgaccctgagccgcaccaacaagaagcggtcctggccgctcaacgaggccatcatggcggtgggcatggtcagcatcctggcctccagcctgctcaagaacgacatccccatgaccggccccctggtggccgggggcctgctcacggtgtgctacgtcctgaccgggcgctccgccgacctggagctcgagcgggccgcggacgtgaagtgggaggaccaggccgagatcagcggcagctcccccatcctgagcatcaccatctccgaggacgggagcatgtccatcaagaacgaggaggaggagcagaccctgacgatcctcatccgcaccggcctgctggtgatcagcggcctcttcccggtctccatccccatcaccgccgccgcctggtacctgtgggaggtgaagaagcagcgggcgggggtgctgtgggacgtcccctccccgccgcccatgggcaaggccgagctcgaggacggggcctaccgcatcaagcagaagggcatcctggggtactcccagatcggcgccggcgtgtacaaggaggggaccttccacaccatgtggcacgtgacgcggggcgccgtcctgatgcacaaggggaagcgcatcgagcccagctgggcggacgtgaagaaggacctcatctcctacggcgggggctggaagctggagggcgagtggaaggagggggaggaggtgcaggtcctggccctcgagcccggcaagaacccccgggccgtgcagaccaagcccgggctgttcaagaccaacaccggcacgatcggggccgtgagcctggacttctcccccggcaccagcggctcccccatcatcgacaagaaggggaaggtcgtgggcctctacgggaacggcgtggtcacccgcagcggcgcctacgtgtccgcgatcgcccagaccgagaagtccatcgaggacaaccccgagatcgaggacgacatcttccggaagaagcgcctgacgatcatggacctgcaccccggggccggcaagaccaagcggtacctgcccgccatcgtgcgcgaggcgatcaagcgggggctccgcaccctgatcctggccccgacccgggtcgtggccgccgagatggaggaggccctccgcggcctgcccatccggtaccagacgcccgcgatccgcgccgagcacaccgggcgggagatcgtggacctgatgtgccacgccaccttcaccatgcgcctcctgtcccccgtccgcgtgccgaactacaacctgatcatcatggacgaggcccacttcacggaccccgccagcatcgcggcccggggctacatcagcacccgcgtggagatgggcgaggccgccgggatcttcatgaccgccacgccgcccggctcccgggacccgttcccccagagcaacgcgcccatcatcgacgaggagcgcgagatccccgagcggtcctggaacagcgggcacgagtgggtcacggacttcaagggcaagaccgtgtggttcgtgccgtccatcaaggccgggaacgacatcgccgcctgcctccgcaagaacggcaagaaggtcatccagctgagccggaagaccttcgactccgagtacgtgaagacccgcacgaacgactgggacttcgtggtcaccaccgacatcagcgagatgggcgcgaacttcaaggccgagcgggtgatcgacccccgccggtgcatgaagcccgtgatcctgaccgacggggaggagcgcgtcatcctcgccggccccatgccggtgacgcactccagcgccgcccagcggcgcgggcggatcggccgcaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgggagaaggtggacgccatcgacggcgagtaccgcctgcgcggggaggcccgcaagaccttcgtcgacctgatgcgccggggcgacctccccgtgtggctggcctacaaggtggcggccgaggggatcaactacgccgaccgccggtggtgcttcgacggcatccagaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgacgctgaacctcatcaccgagatgggccgcctgcccaccttcatgacccagaaggcccgggacgccctggacaacctcgcggtcctgcacacggccgaggccgggggccgcgcctacaaccacgccctgagcgagctccccgagaccctggagaccctgctcctgctgaccctcctggcgacggtgaccgggggcatcttcctgttcctcatgtccggccgggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacctggggttcggcagcatcgccacgcagcagccggagtccaacatcctcgacatcgacctgcggcccgcgagcgcctggaccctgtacgccgtggccaccaccttcgtgacgcccatgctccgccacagcatcgagaactccagcgtcaacgtgtccctgaccgccatcgcgaaccaggccaccgtgctgatgggcctcgggaagggctggcccctgagcaagatggacatcggggtcccgctgctcgccatcggctgctactcccaggtgaaccccatcaccctgacggccgcgctgctcctgctggtggcccactacgccatcatcgggcccggcctccaggccaaggccacccgggaggcgcagaagcgcgccgccgccggcatcatgaagaaccccaccgtcgacgggatcaccgtgatcgacctggacccgatcccctacgaccccaagttcgagaagcagctgggccaggtgatgctcctggtcctgtgcgtgacccaggtgctcatgatgcggaccacctgggccctgtgcgaggcgctgaccctcgccacggggcccatcagcaccctgtgggagggcaacccggggcgcttctggaacaccaccatcgccgtctccatggccaacatcttccggggcagctacctggccggcgcggggctcctgttctccatcatgaagaacacgaccaacacccgccggggcaccgggaacatcggcgagacgctgggcgagaagtggaagtcccgcctcaacgccctggggaagtccgagttccagatctacaagaagtccggcatccaggaggtggaccgcaccctggccaaggaggggatcaagcggggcgagaccgaccaccacgccgtgtcccgcgggagcgcgaagctccggtggttcgtcgagcgcaacatgatcacccccgagggcaaggtggtggacctgggctgcgggcggggcgggtggtcctactactgcggcgggctgaagaacgtccgcgaggtgaagggcctcacgaagggcgggcccggccacgaggagcccatcccgatgagcacctacgggtggaacctggtgcggctgcagtccggcgtcgacgtgttcttcacgccgcccgagaagtgcgacaccctcctgtgcgacatcggggagagctcccccaacccgacggtggaggccggccgcaccctgcgggtcctcaacctggtggagaactggctgaacaacaacacccagttctgcatcaaggtgctcaacccctacatgcccagcgtcatcgagaagatggaggccctgcagcgcaagtacggcggggccctggtgcggaacccgctgagccgcaactccacccacgagatgtactgggtgagcaacgcctccggcaacatcgtcagctccgtgaacatgatcagccggatgctcatcaaccgcttcaccatgaagcacaagaaggcgacgtacgagcccgacgtggacctggggtccggcacccggaacatcgggatcgagagcgaggtccccaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtggtccggctcctgaccaagccgtgggacgtgctgcccaccgtgacgcagatggccatgaccgacaccacccccttcgggcagcagcgcgtcttcaaggagaaggtggacacgcggacccaggagcccaaggagggcaccaagaagctcatgaagatcaccgccgagtggctgtggaaggagctgggcaagaagaagacgccgcgcatgtgcacccgcgaggagttcacccggaaggtgcgcagcaacgcggccctcggggccatcttcaccgacgagaacaagtggaagtccgcccgggaggccgtcgaggacagccgcttctgggagctggtggacaaggagcggaacctgcacctcgagggcaagtgcgagacgtgcgtctacaacatgatggggaagcgcgagaagaagctgggcgagttcgggaaggcgaagggctcccgggccatctggtacatgtggctgggcgcccgcttcctcgagttcgaggccctggggttcctgaacgaggaccactggttcagccgggagaactccctcagcggcgtggagggggagggcctgcacaagctggggtacatcctccgcgacgtgagcaagaaggagggcggcgcgatgtacgccgacgacaccgccgggtgggacacccggatcaccctggaggacctgaagaacgaggagatggtcacgaaccacatggagggcgagcacaagaagctcgccgaggccatcttcaagctgacctaccagaacaaggtggtgcgcgtccagcggcccacgccccgggggaccgtgatggacatcatctcccggcgcgaccagcggggcagcggccaggtggggacgtacggcctgaacaccttcaccaacatggaggcgcagctcatccgccagatggagggggagggcgtcttcaagaacatccagcacctgaccgccacggaggagatcgccgtgcagaactggctggcccgggtggggcgcgagcggctctcccgcatggccatcagcggcgacgactgcgtcgtgaagcccctggacgaccgcttcgcgtccgccctgaccgccctcaacgacatgggcaaggtgcggaaggacatccagcagtgggagccgagccgcgggtggaacgactggacccaggtccccttctgctcccaccacttccacgagctgatcatgaaggacggccgggtgctggtggtcccctgccgcaaccaggacgagctcatcgggcgggcccgcatcagccagggcgccgggtggtccctgcgggagaccgcgtgcctgggcaagagctacgcccagatgtggtccctcatgtacttccaccgccgggacctgcgcctggccgccaacgccatctgcagcgcggtgccctcccactgggtgccgacgagccggaccacctggtccatccacgccaagcacgagtggatgaccaccgaggacatgctcacggtctggaaccgcgtgtggatccaggagaacccctggatggaggacaagacccccgtggagagctgggaggagatcccctacctgggcaagcgggaggaccagtggtgcgggtccctgatcggcctcaccagccgcgccacctgggccaagaacatccaggcggccatcaaccaggtccggagcctgatcgggaacgaggagtacacggactacatgccgtccatgaagcgcttccggcgcgaggaggaggaggccggcgtgctgtggtga

SEQ ID NO: 9802 - RNA, 9876 nt, synthetic construct
  misc_feature 1..9876: note = derived and/or modified CDS sequence (opt1) from DENV-2__AF169679__SS-prME
  source 1..9876: mol_type = other RNA
agcgcgggcatgatcatcatgctgatccccaccgtgatggccttccacctcaccacccgcaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcaccccgggttcaccatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgcccgacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgcaagatccccttcgagatcatggacctggagaagcgctacgtgctcggccggctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcgcatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccggtccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccgcagcgtgacccggctggagaacctcatgtggaagcagatcacccccgagctgaaccacatcctggccgagaacgaggtcaagctcaccatcatgacgggggacatcaagggcatcatgcaggccgggaagcgctccctgcggccgcagcccaccgagctgaagtacagctggaagacctggggcaaggcgaagatgctctccaccgagagccacaaccagacgttcctgatcgacggccccaagaccgccgagtgcccgaacaccaaccgcgcctggaactccctggaggtggaggactacgggttcggcgtgttcaccacgaacatctggctcaagctgaaggagaagcaggacgccttctgcgacagcaagctgatgtccgccgcgatcaaggacaaccgggccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccgcccggggtaccacacccagatcgccggcccctggcacctggggaagctggagatggacttcgacttctgcgacggcaccacggtggtggtcaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctcttcctggaggagatgctgcggacgcgcgtggggaccaagcacgccatcctcctggtcgccgtgagcttcgtgaccctgatcaccggcaacatgtccttcaaggacctcgggcgggtcgtggtgatggtcggcgccacgatgaccgacgacatcgggatgggcgtgacctacctggccctgctcgcggccttcaaggtgcgccccaccttcgccgccggcctgctgctccggaagctgacgagcaaggagctgatgatgaccaccatcgggatcgtcctcctgtcccagagcaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcaccatcctggcggtggtcagcgtgagccccctgatcctcacgagctcccagcagaagaccgactggatccccctggccctgaccatcaaggggctcaaccccaccgccatcttcctgacgaccctgagccgcaccaacaagaagcggtcctggccgctcaacgaggccatcatggcggtgggcatggtcagcatcctggcctccagcctgctcaagaacgacatccccatgaccggccccctggtggccgggggcctgctcacggtgtgctacgtcctgaccgggcgctccgccgacctggagctcgagcgggccgcggacgtgaagtgggaggaccaggccgagatcagcggcagctcccccatcctgagcatcaccatctccgaggacgggagcatgtccatcaagaacgaggaggaggagcagaccctgacgatcctcatccgcaccggcctgctggtgatcagcggcctcttcccggtctccatccccatcaccgccgccgcctggtacctgtgggaggtgaagaagcagcgggcgggggtgctgtgggacgtcccctccccgccgcccatgggcaaggccgagctcgaggacggggcctaccgcatcaagcagaagggcatcctggggtactcccagatcggcgccggcgtgtacaaggaggggaccttccacaccatgtggcacgtgacgcggggcgccgtcctgatgcacaaggggaagcgcatcgagcccagctgggcggacgtgaagaaggacctcatctcctacggcgggggctggaagctggagggcgagtggaaggagggggaggaggtgcaggtcctggccctcgagcccggcaagaacccccgggccgtgcagaccaagcccgggctgttcaagaccaacaccggcacgatcggggccgtgagcctggacttctcccccggcaccagcggctcccccatcatcgacaagaaggggaaggtcgtgggcctctacgggaacggcgtggtcacccgcagcggcgcctacgtgtccgcgatcgcccagaccgagaagtccatcgaggacaaccccgagatcgaggacgacatcttccggaagcgccggctgacgatcatggacctgcaccccggggccggcaagaccaagcgctacctgcccgccatcgtgcgggaggcgatcaagcgcgggctccggaccctgatcctggccccgacccgcgtcgtggccgccgagatggaggaggccctccggggcctgcccatccgctaccagacgcccgcgatccgggccgagcacaccgggcgcgagatcgtggacctgatgtgccacgccaccttcaccatgcgcctcctgtcccccgtccgggtgccgaactacaacctgatcatcatggacgaggcccacttcacggaccccgccagcatcgcggcccgcggctacatcagcacccgggtggagatgggcgaggccgccgggatcttcatgaccgccacgccgcccggctcccgcgacccgttcccccagagcaacgcgcccatcatggacgaggagcgggagatccccgagcgctcctggaacagcgggcacgagtgggtcacggacttcaagggcaagaccgtgtggttcgtgccgtccatcaaggccgggaacgacatcgccgcctgcctccggaagaacggcaagaaggtcatccagctgagccgcaagaccttcgactccgagtacgtgaagacccggacgaacgactgggacttcgtggtcaccaccgacatcagcgagatgggcgcgaacttcaaggccgagcgcgtgatcgacccccggcgctgcatgaagcccgtgatcctgaccgacggggaggagcgggtcatcctcgccggccccatgccggtgacgcactccagcgccgcccagcgccgggggcgcatcggccggaaccccaagaacgagaacgaccagtacatctacatgggggagcccctggagaacgacgaggactgcgcgcactggaaggaggccaagatgctgctcgacaacatcaacacccccgagggcatcatcccgtccatgttcgagcccgagcgcgagaaggtggacgccatcgacggcgagtaccggctgcgcggggaggcccgcaagaccttcgtcgacctgatgcggcgcggcgacctccccgtgtggctggcctacaaggtggcggccgaggggatcaactacgccgaccggcgctggtgcttcgacggcatccggaacaaccagatcctggaggagaacgtcgaggtggagatctggaccaaggagggggagcgcaagaagctcaagccgcggtggctggacgcccgcatctacagcgaccccctggccctcaaggagttcaaggagttcgcggccggccggaagtccctgacgctgaacctcatcaccgagatgggccgcctgcccaccttcatgacccagaaggcccgggacgccctggacaacctcgcggtcctgcacacggccgaggccgggggccgcgcctacaaccacgccctgagcgagctccccgagaccctggagaccctgctcctgctgaccctcctggcgacggtgaccgggggcatcttcctgttcctcatgtccggccgggggatcggcaagatgaccctggggatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacgtacgtcgtgatcgcgatcctcaccgtggtcgccgccaccatggccaacgagatgggcttcctggagaagaccaagaaggacctggggttcggcagcatcgccacgcagcagccggagtccaacatcctcgacatcgacctgcggcccgcgagcgcctggaccctgtacgccgtggccaccaccttcgtgacgcccatgctccgccacagcatcgagaactccagcgtcaacgtgtccctgaccgccatcgcgaaccaggccaccgtgctgatgggcctcgggaagggctggcccctgagcaagatggacatcggggtcccgctgctcgccatcggctgctactcccaggtgaaccccatcaccctgacggccgcgctgctcctgctggtggcccactacgccatcatcgggcccggcctccaggccaaggccacccgggaggcgcagaagcgcgccgccgccggcatcatgaagaaccccaccgtcgacgggatcaccgtgatcgacctggacccgatcccctacgaccccaagttcgagaagcagctgggccaggtgatgctcctggtcctgtgcgtgacccaggtgctcatgatgcggaccacctgggccctgtgcgaggcgctgaccctcgccacggggcccatcagcaccctgtgggagggcaacccggggcgcttctggaacaccaccatcgccgtctccatggccaacatcttccggggcagctacctggccggcgcggggctcctgttctccatcatgaagaacacgaccaacacccgccgcggcaccgggaacatcggcgagacgctgggcgagaagtggaagtcccggctcaacgccctggggaagtccgagttccagatctacaagaagtccggcatccaggaggtggaccgcaccctggccaaggaggggatcaagcggggcgagaccgaccaccacgccgtgtcccgcgggagcgcgaagctccggtggttcgtcgagcgcaacatgatcacccccgagggcaaggtggtggacctgggctgcgggcggggcgggtggtcctactactgcggcgggctgaagaacgtccgcgaggtgaagggcctcacgaagggcgggcccggccacgaggagcccatcccgatgagcacctacgggtggaacctggtgcggctgcagtccggcgtcgacgtgttcttcacgccgcccgagaagtgcgacaccctcctgtgcgacatcggggagagctcccccaacccgacggtggaggccggccgcaccctgcgggtcctcaacctggtggagaactggctgaacaacaacacccagttctgcatcaaggtgctcaacccctacatgcccagcgtcatcgagaagatggaggccctgcagcgcaagtacggcggggccctggtgcggaacccgctgagccgcaactccacccacgagatgtactgggtgagcaacgcctccggcaacatcgtcagctccgtgaacatgatcagccggatgctcatcaaccgcttcaccatgaagcacaagaaggcgacgtacgagcccgacgtggacctggggtccggcacccggaacatcgggatcgagagcgaggtccccaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtggtccggctcctgaccaagccgtgggacgtgctgcccaccgtgacgcagatggccatgaccgacaccacccccttcgggcagcagcgcgtcttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgcagcaacgcggccctcggggccatcttcaccgacgagaacaagtggaagtccgcccgggaggccgtcgaggacagccgcttctgggagctggtggacaaggagcggaacctgcacctcgagggcaagtgcgagacgtgcgtctacaacatgatggggaagcgcgagaagaagctgggcgagttcgggaaggcgaagggctcccgggccatctggtacatgtggctgggcgcccgcttcctcgagttcgaggccctggggttcctgaacgaggaccactggttcagccgggagaactccctcagcggcgtggagggggagggcctgcacaagctggggtacatcctccgcgacgtgagcaagaaggagggcggcgcgatgtacgccgacgacaccgccgggtgggacacccggatcaccctggaggacctgaagaacgaggagatggtcacgaaccacatggagggcgagcacaagaagctcgccgaggccatcttcaagctgacctaccagaacaaggtggtgcgcgtccagcggcccacgccccgggggaccgtgatggacatcatctcccggcgcgaccagcggggcagcggccaggtggggacgtacggcctgaacaccttcaccaacatggaggcgcagctcatccgccagatggagggggagggcgtcttcaagaacatccagcacctgaccgccacggaggagatcgccgtgcagaactggctggcccgggtggggcgcgagcgcctctcccggatggccatcagcggcgacgactgcgtcgtgaagcccctggacgaccgcttcgcgtccgccctgaccgccctcaacgacatgggcaaggtgcggaaggacatccagcagtgggagccgagccgcgggtggaacgactggacccaggtccccttctgctcccaccacttccacgagctgatcatgaaggacggccgggtgctggtggtcccctgccgcaaccaggacgagctcatcgggcgggcccgcatcagccagggcgccgggtggtccctgcgggagaccgcgtgcctgggcaagagctacgcccagatgtggtccctcatgtacttccaccgccgggacctgcgcctggccgccaacgccatctgcagcgcggtgccctcccactgggtgccgacgagccggaccacctggtccatccacgccaagcacgagtggatgaccaccgaggacatgctcacggtctggaaccgcgtgtggatccaggagaacccctggatggaggacaagacccccgtggagagctgggaggagatcccctacctgggcaagcgggaggaccagtggtgcgggtccctgatcggcctcaccagccgcgccacctgggccaagaacatccaggcggccatcaaccaggtccggagcctgatcgggaacgaggagtacacggactacatgccgtccatgaagcgcttccggcgcgaggaggaggaggccggcgtgctgtggtga

SEQ ID NO: 9803 - RNA, 9876 nt, synthetic construct
  misc_feature 1..9876: note = derived and/or modified CDS sequence (opt1) from DENV-2__AF169680__SS-prME
  source 1..9876: mol_type = other RNA
agcgcggggatgatcatcatgctgatccccaccgtgatggccttccacctcaccacccgcaacggggagccccacatgatcgtcagcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaactccaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcaccccgggttcaccatcatggccgcgatcctggcctacaccatcggcaccacccacttccagcgcgccctcatcttcatcctgctgaccgccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgcccgacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgcatcatccccttcgagatcatggacctggagaagcgctacgtgctcggccggctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcgcatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccggtccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccgcagcgtgacccggctggagaacctcatgtggaagcagatcacccccgagctgaaccacatcctggccgagaacgaggtcaagctcaccatcatgacgggggacatcaagggcatcatgcaggccgggaagcgctccctgcggccgcagcccaccgagctgaagtacagctggaagacctggggcaaggcgaagatgctctccaccgagagccacaaccagaacttcctgatcgacggccccgagacggccgagtgcccgaacaccaaccgcgcctggaactccctggaggtggaggactacgggttcggcgtgttcaccaccaacgtctggctcaagctgaaggagaagcaggacgccttctgcgacagcaagctgatgtccgccgcgatcaaggacaaccgggccgtgcacgccgacatggggtactggatcgagagcgccctcaacgacacgtggaagatcgagaaggcctccttcatcgaggtgaagaactgccactggcccaagagccacaccctgtggtccaacggcgtcctggagagcgagatgatcatccccaagaacctcgcgggccccgtgtcccagcacaactaccgcccggggtaccacacccagatcgccggcccctggcacctggggaagctggagatggacttcgacttctgcgacggcaccaccgtggtcgtgacggaggactgcgggaaccggggccccagcctccgcaccaccaccgccagcggcaagctgatcacggagtggtgctgccggtcctgcaccctgcccccgctccgctaccgcggggaggacggctgctggtacgggatggagatccgccccctgaaggagaaggaggagaacctggtgaacagcctcgtcaccgccggccacggccaggtggacaacttctccctgggcgtgctgggcatggccctgttcctggaggagatgctgcggacccgcgtcgggacgaagcacgccatcctcctggtggccgtgagcttcgtcaccctgatcaccggcaacatgtccttcaaggacctcgggcgggtggtggtcatggtgggcgccaccatgacggacgacatcgggatgggcgtgacctacctggccctgctcgcggccttcaaggtccgccccaccttcgccgccggcctgctgctccggaagctgaccagcaaggagctgatgatgacgaccatcgggatcgtgctcctgtcccagagcaccatccccgagaccatcctggagctcacggacgccctggcgctgggcatgatggtgctcaagatcgtccgcaacatggagaagtaccagctggccgtgaccatcatggccatcctgtgcgtcccgaacgccgtgatcctccagaacgcctggaaggtgtcctgcaccatcctggcggtcgtgagcgtgagccccctgatcctcaccagctcccagcagaagacggactggatccccctggccctgaccatcaaggggctcaaccccaccgccatcttcctgaccacgctgagccgcaccaacaagaagcggtcctggccgctcaacgaggccatcatggcggtcggcatggtgagcatcctggcctccagcctgctcaagaacgacatccccatgaccggccccctggtggccgggggcctgctcaccgtctgctacgtgctgacggggcgctccgccgacctggagctcgagcgggccaccgacgtgaagtgggagcgccaggcggagatcagcggcagctcccccatcctgagcatcaccatctccgaggacgggagcatgtccatcaagaacgaggaggaggagcagaccctgacgatcctcatccggaccggcctgctggtcatcagcggcctcttcccggtgtccatccccatcaccgccgccgcctggtacctgtgggaggtgaagaagcagcgcgccggggtcctgtgggacgtgccctccccgccgcccatgggcaaggcggagctcgaggacggggcctaccggatcaagcagaagggcatcctggggtactcccagatcggcgccggcgtgtacaaggaggggaccttccacaccatgtggcacgtcacgcgcggcgccgtgctgatgcacaaggggaagcggatcgagcccagctgggccgacgtgaagaaggacctcatctcctacggcgggggctggaagctggagggcgagtggaaggagggggaggaggtccaggtgctggcgctcgagcccggcaagaacccccgcgccgtgcagaccaagcccgggctgttcaagaccaacaccggcacgatcggggccgtcagcctggacttctcccccggcaccagcggctcccccatcatcgacaagaaggggaaggtggtgggcctctacgggaacggcgtcgtgacccggagcggcgcctacgtgtccgccatcgcgcagaccgagaagtccatcgaggacaaccccgagatcgaggacgacatcttccgcaagcggaagatgacgatcatggacctgcaccccggggccggcaagaccaagcgctacctgcccgccatcgtccgggaggccatcaagcgcgggctgcggaccctcatcctggcgccgacccgcgtggtggccgccgagatggaggaggccctgcggggcctccccatccgctaccagacgcccgccatccgggcggagcacaccgggcgcgagatcgtcgacctgatgtgccacgccaccttcaccatgcgcctgctctcccccgtgcgggtgccgaactacaacctgatcatcatggacgaggcccacttcacggaccccgccagcatcgccgcgcgcggctacatcagcacccgggtcgagatgggcgaggccgccgggatcttcatgaccgccacgccgcccggctcccgcgacccgttcccccagagcaacgcccccatcatcgacgaggagcgggagatccccgagcgctcctggaacagcgggcacgagtgggtgacggacttcaagggcaagaccgtgtggttcgtcccgtccatcaaggcggggaacgacatcgccgcctgcctgcggaagaacggcaagaaggtgatccagctcagccgcaagaccttcgactccgagtacgtgaagacccggacgaacgactgggacttcgtcgtgaccaccgacatcagcgagatgggcgccaacttcaaggcggagcgcgtgatcgacccccggcgctgcatgaagcccgtcatcctgaccgacggggaggagcgggtgatcctggccggccccatgccggtgacgcactccagcgccgcccagcgccgggggcgcatcggccggaaccccaagaacgagaacgaccagtacatctacatgggggagcccctcgagaacgacgaggactgcgcccactggaaggaggcgaagatgctgctggacaacatcaacacccccgagggcatcatcccgtccatgttcgagcccgagcgcgagaaggtcgacgccatcgacggcgagtaccggctccgcggggaggcccgcaagaccttcgtggacctgatgcggcgcggcgacctgcccgtgtggctcgcctacaaggtcgccgcggaggggatcaactacgccgaccggcgctggtgcttcgacggcatccggaacaaccagatcctggaggagaacgtggaggtcgagatctggaccaaggagggggagcgcaagaagctgaagccgcggtggctcgacgcccgcatctacagcgaccccctggccctgaaggagttcaaggagttcgccgcgggccggaagtccctcacgctgaacctgatcaccgagatgggccgcctccccaccttcatgacccagaaggcccgggacgccctggacaacctggccgtgctccacacggcggaggccgggggccgcgcctacaaccacgccctgagcgagctgcccgagaccctcgagaccctgctgctcctgaccctgctcgccacggtgaccgggggcatcttcctgttcctgatgtccggccgggggatcggcaagatgaccctcgggatgtgctgcatcatcaccgcgagcatcctgctgtggtacgcccagatccagccgcactggatcgccgcctccatcatcctcgagttcttcctgatcgtcctgctcatccccgagcccgagaagcagcgcacgccccaggacaaccagctgacgtacgtggtgatcgccatcctgaccgtcgtggcggccaccatggccaacgagatgggcttcctcgagaagaccaagaaggacctggggttcggcagcatcgccacgcagcagccggagtccaacatcctggacatcgacctccggcccgccagcgcgtggaccctgtacgccgtggccaccaccttcgtcacgcccatgctgcgccacagcatcgagaactccagcgtgaacgtgtccctcaccgccatcgccaaccaggcgaccgtcctgatgggcctggggaagggctggcccctcagcaagatggacatcggggtgccgctgctggccatcggctgctactcccaggtgaaccccatcaccctcacggccgccctgctgctcctggtcgcgcactacgccatcatcgggcccggcctgcaggccaaggccacccgggaggcccagaagcgcgcggccgccggcatcatgaagaaccccagcgtggacgggatcaccgtgatcgacctcgacccgatcccctacgaccccaagttcgagaagcagctgggccaggtcatgctgctcgtgctgtgcgtgacccaggtcctgatgatgcggacgacctgggccctctgcgaggccctgaccctggcgaccgggcccatctccacgctctgggagggcaacccggggcgcttctggaacaccaccatcgccgtgagcatggccaacatcttccggggctcctacctggccggcgccgggctcctcttcagcatcatgaagaacaccacgaacacccgccgcggcaccgggaacatcggcgagaccctgggcgagaagtggaagtcccggctgaacgcgctcggcaagagcgagttccagatctacaagaagtccggcatccaggaggtggaccgcacgctggccaaggaggggatcaagcggggcgagaccgaccaccacaccgtcagccgcgggtccgccaagctgcggtggttcgtggagcgcaacatgatcacccccgagggcaaggtgctcgacctgggctgcgggcggggcgggtggagctactactgcggcgggctgaagaacgtccgcgaggtgaagggcctcacgaagggcgggcccggccacgaggagcccatcccgatgtccacctacgggtggaacctggtgcggctgcagagcggcgtcgacgtgttcttcacgccgcccgagaagtgcgacaccctcctgtgcgacatcggggagtccagccccaacccgacggtggaggccggccgcaccctgcgggtcctcaacctggtggagaactggctgaacaacaacacccagttctgcatcaaggtgctcaacccctacatgcccagcgtcatcgagaagatggaggcgctgcagcgcaagtacggcggggccctggtgcggaacccgctgtcccgcaacagcacccacgagatgtactgggtgtccaacgccagcggcaacatcgtctccagcgtgaacatgatctcccggatgctcatcaaccgcttcaccatgaagcacaagaaggccacgtacgagcccgacgtggacctggggagcggcacccggaacatcgggatcgagtccgaggtccccaacctggacatcatcggcaagcgcatcgagaagatcaagcaggagcacgagaccagctggcactacgaccaggaccacccctacaagacctgggcctaccacggctcctacgagacgaagcagaccgggagcgcgtccagcatggtgaacggcgtggtccggctcctgaccaagccgtgggacgtgctgcccaccgtgacgcagatggccatgaccgacaccacccccttcgggcagcagcgcgtcttcaaggagaaggtggacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgctccaacgccgccctcggggcgatcttcaccgacgagaacaagtggaagtccgcccgggaggccgtcgaggactcccgcttctgggagctggtggacaaggagcggaacctgcacctcgagggcaagtgcgagacgtgcgtctacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttctcccgggagaacagcctcagcggcgtggagggggagggcctgcacaagctggggtacatcctccgcgacgtgtccaagaaggagggcggcgccatgtacgccgacgacaccgcggggtgggacacccggatcaccctggaggacctgaagaacgaggagatggtcacgaaccacatggagggcgagcacaagaagctcgccgaggccatcttcaagctgacctaccagaacaaggtggtgcgcgtccagcggcccacgccccgggggaccgtgatggacatcatcagccggcgcgaccagcggggctccggccaggtggggacgtacggcctgaacaccttcaccaacatggaggcccagctcatccgccagatggagggggagggcgtcttcaagaacatccagcacctgaccgccacggaggagatcgcggtgcagaactggctggcccgggtggggcgcgagcgcctcagccggatggccatctccggcgacgactgcgtcgtgaagcccctggacgaccgcttcgccagcgccctgaccgcgctcaacgacatgggcaaggtgcggaaggacatccagcagtgggagccgtcccgcgggtggaacgactggacccaggtccccttctgcagccaccacttccacgagctgatcatgaaggacggccgggtgctggtggtcccctgccgcaaccaggacgagctcatcgggcgggcccgcatctcccagggcgccgggtggagcctgcgggagaccgcctgcctgggcaagtcctacgcccagatgtggagcctcatgtacttccaccgccgggacctgcgcctggcggccaacgccatctgctccgccgtgcccagccactgggtgccgacgtcccggaccacctggagcatccacgccaagcacgagtggatgaccaccgaggacatgctcacggtctggaaccgcgtgtggatccaggagaacccctggatggaggacaagacccccgtggagtcctgggaggagatcccctacctgggcaagcgggaggaccagtggtgcgggagcctgatcggcctcaccagccgcgcgacctgggccaagaacatccaggccgccatcaaccaggtccggtccctgatcgggaacgaggagtacacggactacatgccgagcatgaagcgcttccggcgcgaggaggaggaggcgggcgtgctgtggtga

SEQ ID NO: 9804 - RNA, 9876 nt, synthetic construct
  misc_feature 1..9876: note = derived and/or modified CDS sequence (opt1) from DENV-2__AF169682__SS-prME
  source 1..9876: mol_type = other RNA
agcgcggggatgatcatcatgctgatccccaccgtgatggccttccacctcaccacccgcaacggggagccccacatgatcgtctccatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaactccaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcaccccgggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgcccgacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgccgcatccccttcgagatcatggacctggagaagcggtacgtgctcggccgcctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccgctccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccggagcgtgacccgcctggagaacctcatgtggaagcagatcacccccgagctgaaccacatcctggccgagaacgaggtcaagctcaccatcatgacgggggacatcaagggcatcatgcaggccgggaagcggtccctgcgcccgcagcccaccgagctgaagtacagctggaagacctggggcaaggcgaagatgctctccaccgagagccacaaccagacgttcctgatcgacggccccgagaccgccgagtgcccgaacaccaaccgggcctggaactccctggaggtggaggactacgggttcggcgtgttcaccacgaacatctggctcaagctgaaggagaagcaggacgccttctgcgacagcaagctgatgtccgccgcgatcaaggacaaccgcgccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccggccggggtaccacacccagatcgccggcccctggcacctggggaagctggagatggacttcgacttctgcgacggcaccacggtggtggtcaccgaggactgcgggaaccgcggccccagcctccggaccaccacggccagcggcaagctgatcaccgagtggtgctgccgctcctgcaccctgcccccgctccggtaccgcggggaggacggctgctggtacgggatggagatccggcccctgaaggagaaggaggagaacctggtgaacagcctcgtgaccgccggccacgggcaggtcgacaacttctccctgggcgtgctgggcatggccctcttcctggaggagatgctgcgcacgcgggtggggaccaagcacgccatcctcctggtcgccgtgagcttcgtgaccctgatcaccggcaacatgtccttcaaggacctcgggcgcgtcgtggtgatggtcggcgccacgatgaccgacgacatcgggatgggcgtgacctacctggccctgctcgcggccttcaaggtgcggcccaccttcgccgccggcctgctgctccgcaagctgacgagcaaggagctgatgatgaccaccatcgggatcgtcctcctgtcccagagcaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcaccatcctggcggtggtcagcgtgagccccctgatcctcacgagctcccagcagaagaccgactggatccccctggccctgaccatcaaggggctcaaccccaccgccatcttcctgacgaccctgagccggaccaacaagaagcgctcctggccgctcaacgaggccatcatggcggtgggcatggtcagcatcctggcctccagcctgctcaagaacgacatccccatgaccggccccctggtggccgggggcctgctcacggtgtgctacgtcctgaccgggcggtccgccgacctggagctcgagcgcgccaccgacgtgaagtgggaggaccaggcggagatcagcggcagctcccccagcctgtccatcaccatcagcgaggacgggtccatgagcatcaagaacgaggaggaggagcagacgctgaccatcctcatccggaccggcctgctggtgatctccggcctcttcccggtcagcatccccatcaccgccgccgcctggtacctgtgggaggtgaagaagcagcgcgccggggtgctgtgggacgtccccagcccgccgcccatgggcaaggcggagctcgaggacggggcctaccggatcaagcagaagggcatcctggggtacagccagatcggcgccggcgtgtacaaggaggggaccttccacacgatgtggcacgtgacccgcggcgccgtcctgatgcacaaggggaagcggatcgagccctcctgggccgacgtgaagaaggacctcatcagctacggcgggggctggaagctggagggcgagtggaaggagggggaggaggtgcaggtcctggcgctcgagcccggcaagaacccccgcgccgtgcagaccaagcccgggctgttcaagaccaacacgggcaccatcggggccgtgtccctggacttcagccccggcacctccggcagccccatcatcgacaagaaggggaaggtcgtgggcctctacgggaacggcgtggtcacccggtccggcgcctacgtgagcgccatcgcgcagacggagaagtccatcgaggacaaccccgagatcgaggacgacatcttccgcaagcggcgcctgaccatcatggacctgcaccccggggccggcaagaccaagcggtacctgcccgccatcgtgcgcgaggccatcaagcgggggctccgcaccctgatcctggcgccgacgcgggtcgtggccgccgagatggaggaggccctccgcggcctgcccatccggtaccagacccccgccatccgcgcggagcacaccgggcgcgagatcgtggacctgatgtgccacgccaccttcacgatgcggctcctgagccccgtccgcgtgccgaactacaacctgatcatcatggacgaggcccacttcaccgaccccgccagcatcgccgcgcggggctacatctccacccgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagaccgtgtggttcgtgccgagcatcaaggcggggaacgacatcgccgcctgcctccgcaagaacggcaagaaggtcatccagctgtcccggaagaccttcgacagcgagtacgtgaagacgcgcaccaacgactgggacttcgtggtcaccaccgacatctccgagatgggcgccaacttcaaggcggagcgggtgatcgacccccgccggtgcatgaagcccgtgatcctgacggacggggaggagcgcgtcatcctcgccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccggaagaccttcgtcgacctgatgcgccggggcgacctccccgtgtggctggcctacaaggtggccgcggaggggatcaactacgccgaccgccggtggtgcttcgacggcatcaagaacaaccagatcctggaggagaacgtcgaggtggagatctggacgaaggagggggagcgcaagaagctcaagccgcggtggctggacgcccgcatctactccgaccccctggccctcaaggagttcaaggagttcgccgcgggccggaagtccctggccctgaacctcatcaccgagatgggccgcctgcccaccttcatgacccagaagacgcgggacgccctggacaacctcgccgtcctgcacaccgcggaggccgggggccgcgcctacaaccacgccctgtccgagctccccgagaccctggagaccctgctcctgctgacgctcctggccaccgtgaccgggggcatcttcctgttcctcatgagcggccgggggatcggcaagatgaccctggggatgtgctgcatcatcaccgcgtccatcctgctctggtacgcccagatccagccgcactggatcgccgccagcatcatcctggtgttcttcctgatcgtcctcctgatccccgagcccgagaagcagcgcacgccccaggacaaccagctgacctacgtggtgatcgccatcctcaccgtcgtggcggccaccatggccaacgagatgggcttcctggagaagacgaagaaggacctggggttcggctccatcgccacccagcagccggagagcaacatcctcgacatcgacctgcggcccgccagcgcgtggaccctgtacgccgtggccaccacgttcgtcacccccatgctccgccactccatcgagaacagctccgtgaacgtgagcctgaccgccatcgccaaccaggcgaccgtcctgatgggcctcgggaagggctggcccctgtccaagatggacatcggggtgccgctgctcgccatcggctgctacagccaggtgaaccccatcacgctgaccgccgccctgctcctgctggtcgcgcactacgccatcatcgggcccggcctccaggccaaggccacccgggaggcccagaagcgcgcggccgccggcatcatgaagaaccccaccgtggacgggatcacggtgatcgacctggacccgatcccctacgaccccaagttcgagaagcagctgggccaggtcatgctcctggtgctgtgcgtgacccaggtcctcatgatgcggaccacctgggccctgtgcgaggccctgacgctcgcgaccgggcccatctccaccctgtgggagggcaacccggggcgcttctggaacaccacgatcgccgtgagcatggccaacatcttccggggctcctacctggccggcgccgggctcctgttcagcatcatgaagaacaccaccaacacccgccgcggcacggggaacatcggcgagaccctgggcgagaagtggaagtcccggctcaacgcgctggggaagtccgagttccagatctacaagaagtccggcatccaggaggtggaccgcaccctggccaaggaggggatcaagcggggcgagaccgaccaccacgccgtcagccgcgggtccgccaagctccggtggttcgtggagcgcaacatggtgacgcccgagggcaaggtcgtggacctgggctgcgggcggggcgggtggagctactactgcggcgggctgaagaacgtgcgcgaggtcaagggcctcaccaagggcgggcccggccacgaggagcccatcccgatgtccacctacgggtggaacctggtgcggctgcagagcggcgtggacgtcttcttcacgccgcccgagaagtgcgacacgctcctgtgcgacatcggggagtccagccccaacccgaccgtggaggcgggccgcaccctgcgggtgctcaacctggtcgagaactggctgaacaacaacacccagttctgcatcaaggtgctcaacccctacatgcccagcgtgatcgagaagatggaggccctgcagcgcaagtacggcggggccctggtccggaacccgctgtcccgcaacagcacccacgagatgtactgggtgtccaacgccagcggcaacatcgtgtccagcgtcaacatgatctcccggatgctcatcaaccgcttcacgatgaagcacaagaaggccacctacgagcccgacgtggacctggggagcggcacccggaacatcgggatcgagtccgaggtgcccaacctggacatcatcggcaagcgcatcgagaagatcaagcaggagcacgagaccagctggcactacgaccaggaccacccctacaagacgtgggcgtaccacggctcctacgagaccaagcagaccgggagcgcctccagcatggtcaacggcgtggtgcggctcctgaccaagccgtgggacgtcctgcccacggtgacccagatggccatgaccgacaccacgcccttcgggcagcagcgcgtgttcaaggagaaggtcgacacccgcacccaggagcccaaggagggcaccaagaagctcatgaagatcacggccgagtggctgtggaaggagctgggcaagaagaagaccccgcggatgtgcacccgcgaggagttcacccggaaggtgcgctccaacgccgcgctcggggccatcttcacggacgagaacaagtggaagtccgcccgggaggccgtcgaggactcccgcttctgggagctggtggacaaggagcggaacctgcacctcgagggcaagtgcgagacctgcgtgtacaacatgatggggaagcgcgagaagaagctgggcgagttcgggaaggccaagggcagccgggcgatctggtacatgtggctgggcgcccgcttcctcgagttcgaggccctggggttcctgaacgaggaccactggttctcccgggagaacagcctcagcggcgtcgagggggagggcctgcacaagctggggtacatcctccgcgacgtgtccaagaaggagggcggcgccatgtacgcggacgacaccgccgggtgggacacccggatcacgctggaggacctgaagaacgaggagatggtgaccaaccacatggagggcgagcacaagaagctcgccgaggccatcttcaagctgacctaccagaacaaggtcgtgcgcgtgcagcggcccacgccccgcgggacggtcatggacatcatcagccggcgcgaccagcggggctccggccaggtgggcacctacggcctgaacaccttcaccaacatggaggcccagctcatccgccagatggagggggagggcgtgttcaagaacatccagcacctgacggcgaccgaggagatcgccgtccagaactgcctggcccggctcgggcgcgagcgcctgagccggatggccatctccggcgacgactgcgtggtgaagcccctggacgaccgcttcgccagcgcgctcaccgccctgaacgacatgggcaagatccggaaggacatccagcagtgggagccgtcccgcgggtggaacgactggacccaggtccccttctgcagccaccacttccacgagctgatcatgaaggacggccgggtgctcgtggtcccctgccgcaaccaggacgagctgatcgggcgggcccgcatctcccagggcgccgggtggagcctgcgggagacggcctgcctcggcaagtcctacgcgcagatgtggagcctgatgtacttccaccgccgggacctgcgcctcgccgccaacgccatctgctccgccgtgcccagccactgggtgccgacctcccggaccacctggagcatccacgcgaagcacgagtggatgaccacggaggacatgctgaccgtctggaaccgcgtgtggatccaggagaacccctggatggaggacaagacccccgtggagtcctgggaggagatcccctacctgggcaagcgggaggaccagtggtgcgggagcctcatcggcctgaccagccgcgccacgtgggccaagaacatccaggccgcgatcaaccaggtccggtccctgatcgggaacgaggagtacaccgactacatgccgagcatgaagcgcttccggcgcgaggaggaggaggccggcgtgctctggtga

SEQ ID NO: 9805 - RNA, 9876 nt, synthetic construct
  misc_feature 1..9876: note = derived and/or modified CDS sequence (opt1) from DENV-2__AF169681__SS-prME
  source 1..9876: mol_type = other RNA
agcgccgggatgatcatcatgctgatccccaccgtgatggccttccacctcaccacccgcaacggggagccgcacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacgtgcaccaccaccggcgagcaccgccgggagaagcgctccgtcgccctggtgccccacgtgggcatggggctcgagacgcggaccgagacctggatgagctccgagggcgcctggaagcacgcccagcgcatcgagacctggatcctgcggcaccccgggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgcccgacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgccgcatccccttcgagatcatggacctggagaagcggtacgtgctcggccgcctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccgctccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccggagcgtgacccgcctggagaacctcatgtggaagcagatcacccccgagctgaaccacatcctggccgagaacgaggtcaagctcaccatcatgacgggggacatcaagggcatcatgcaggccgggaagcggtccctgcgcccgcagcccaccgagctgaagtacagctggaagacctggggcaaggcgaagatgctctccaccgagagccacaaccagacgttcctgatcgacggccccaagaccgccgagtgcccgaacaccaaccgggcctggaactccctggaggtggaggactacgggttcggcgtgttcaccacgaacatctggctcaagctgaaggagaagcaggacgccctgtgcgacagcaagctcatgtccgccgcgatcaaggacaaccgcgccgtccacgccgacatggggtactggatcgagagcgccctgaacgacacctggaagatcgagaaggcctccttcatcgaggtgaagaactgccactggcccaagagccacaccctgtggtccaacggcgtgctcgagagcgagatgatcatccccaagaacctggcgggccccgtctcccagcacaactaccggccggggtaccacacccagatcgccggcccctggcacctggggaagctcgagatggacttcgacttctgcgacggcaccacggtggtggtcaccgaggactgcgggaaccgcggccccagcctgcggaccaccacggccagcggcaagctgatcaccgagtggtgctgccgctcctgcaccctcccgcccctgcggtaccgcggggaggacggctgctggtacgggatggagatccggcccctgaaggagaaggaggagaacctcgtgaacagcctggtgaccgccggccacgggcaggtcgacaacttctccctgggcgtgctcggcatggcgctgttcctggaggagatgctccgcacgcgggtggggaccaagcacgccatcctgctggtcgccgtgagcttcgtgaccctcatcaccggcaacatgtccttcaaggacctggggcgcgtcgtggtgatggtcggcgccacgatgaccgacgacatcgggatgggcgtgacctacctggccctcctggcggccttcaaggtgcggcccaccttcgccgccggcctgctcctgcgcaagctgacgagcaaggagctcatgatgaccaccatcgggatcgtcctgctgtcccagagcaccatccccgagacgatcctcgagctgaccgacgccctggcgctcggcatgatggtgctgaagatcgtgcgcaacatggagaagtaccagctggccgtcaccatcatggccatcctctgcgtgcccaacgccgtcatcctgcagaacgcctggaaggtgtcctgcaccatcctggcggtggtcagcgtgagccccctcatcctgacgagctcccagcagaagaccgactggatccccctggccctcaccatcaaggggctgaaccccaccgccatcttcctgacgaccctcagccggaccaacaagaagcgctcctggccgctgaacgaggccatcatggcggtgggcatggtcagcatcctggcctccagcctcctgaagaacgacatccccatgaccggccccctggtggccgggggcctcctgacggtgtgctacgtcctgaccgggcggtccgccgacctcgagctggagcgcgccaccgacgtgaagtgggagaaccaggcggagatcagcggcagctcccccatcctgagcatcaccatctccgaggacgggagcatgtccatcaagaacgaggaggaggagcagacgctcaccatcctgatccggaccggcctgctcgtgatcagcggcctgttcccggtctccatccccatcaccgccgccgcctggtacctgtgggaggtgaagaagcagcgcgccggggtgctctgggacgtcccctccccgccgcccatgggcaaggcggagctggaggacggggcctaccggatcaagcagaagggcatcctggggtactcccagatcggcgccggcgtgtacaaggaggggaccttccacacgatgtggcacgtgacccgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgcgctggagcccggcaagaacccccgcgccgtgcagaccaagcccgggctgttcaagaccaacacgggcaccatcggggccgtgagcctcgacttctcccccggcaccagcggctcccccatcatcgacaagaaggggaaggtcgtgggcctgtacgggaacggcgtggtcacccggagcggcgcctacgtgtccgccatcgcgcagacggagaagtccatcgaggacaaccccgagatcgaggacgacatcttccgcaagcggcgcctgaccatcatggacctgcaccccggggccggcaagaccaagcggtacctccccgccatcgtgcgcgaggccatcaagcgggggctgcgcaccctgatcctcgcgccgacgcgggtcgtggccgccgagatggaggaggccctgcgcggcctgcccatccggtaccagacccccgccatccgcgcggagcacaccgggcgcgagatcgtggacctcatgtgccacgccaccttcacgatgcggctgctgtcccccgtccgcgtgccgaactacaacctcatcatcatggacgaggcccacttcaccgaccccgccagcatcgccgcgcggggctacatcagcacccgcgtggagatgggcgaggccgccgggatcttcatgaccgccacgccgcccggctcccgggacccgttcccccagagcaacgcccccatcatcgacgaggagcgcgagatccccgagcggtcctggaacagcgggcacgagtgggtcaccgacttcaagggcaagaccgtgtggttcgtgccgtccatcaaggcggggaacgacatcgccgcctgcctgcgcaagaacggcaagaaggtcatccagctgagccggaagaccttcgactccgagtacgtgaagacgcgcaccaacgactgggacttcgtggtcaccaccgacatcagcgagatgggcgccaacttcaaggcggagcgggtgatcgacccccgccggtgcatgaagcccgtgatcctcacggacggggaggagcgcgtcatcctggccggccccatgccggtgacccactccagcgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggacgaaggagggggagcgcaagaagctgaagccgcggtggctggacgcccgcatctacagcgaccccctcgccctgaaggagttcaaggagttcgccgcgggccggaagtccctggccctcaacctgatcaccgagatgggccgcctgcccaccttcatgacccagaagacgcgggacgccctcgacaacctggccgtcctgcacaccgcggaggccgggggccgcgcctacaaccacgccctcagcgagctgcccgagaccctggagaccctcctgctgctcacgctgctggccaccgtgaccgggggcatcttcctcttcctgatgtccggccgggggatcggcaagatgaccctggggatgtgctgcatcatcaccgcgagcatcctcctgtggtacgcccagatccagccgcactggatcgccgcctccatcatcctggtgttcttcctcatcgtcctgctgatccccgagcccgagaagcagcgcacgccccaggacaaccagctcacctacgtggtgatcgccatcctgaccgtcgtggcggccaccatggccaacgagatgggcttcctggagaagacgaagaaggacctcgggttcggcagcatcgccacccagcagccggagtccaacatcctggacatcgacctgcggcccgccagcgcgtggaccctctacgccgtggccaccacgttcgtcacccccatgctgcgccacagcatcgagaactccagcgtgaacgtgtccctgaccgccatcgccaaccaggcgaccgtcctcatgggcctggggaagggctggcccctgagcaagatggacatcggggtgccgctcctggccatcggctgctactcccaggtgaaccccatcacgctgaccgccgccctcctgctgctcgtcgcgcactacgccatcatcgggcccggcctgcaggccaaggccacccgggaggcccagaagcgcgcggccgccggcatcatgaagaaccccaccgtggacgggatcacggtgatcgacctggacccgatcccctacgaccccaagttcgagaagcagctcggccaggtcatgctgctggtgctctgcgtgacccaggtcctgatgatgcggaccacctgggccctgtgcgaggccctcacgctggcgaccgggcccatcagcaccctgtgggagggcaacccggggcgcttctggaacaccacgatcgccgtgtccatggccaacatcttccggggcagctacctcgccggcgccgggctgctgttctccatcatgaagaacaccaccaacacccgccgcggcacggggaacatcggcgagaccctcggcgagaagtggaagtcccggctgaacgcgctggggaagtccgagttccagatctacaagaagtccggcatccaggaggtggaccgcaccctcgccaaggaggggatcaagcggggcgagaccgaccaccacgccgtctcccgcgggagcgccaagctgcggtggttcgtggagcgcaacatggtgacgcccgagggcaaggtcgtggacctgggctgcgggcggggcgggtggtcctactactgcggcgggctcaagaacgtgcgcgaggtcaagggcctgaccaagggcgggcccggccacgaggagcccatcccgatgagcacctacgggtggaacctggtgcggctccagtccggcgtggacgtcttcttcatcccgcccgagaagtgcgacaccctgctgtgcgacatcggggagagctcccccaacccgacggtggaggcgggccgcaccctccgggtgctgaacctggtcgagaactggctcaacaacaacacccagttctgcatcaaggtgctgaacccctacatgcccagcgtgatcgagaagatggaggccctgcagcgcaagtacggcggggccctggtccggaacccgctcagccgcaactccacccacgagatgtactgggtgagcaacgcctccggcaacatcgtgagctccgtcaacatgatcagccggatgctgatcaaccgcttcaccatgcggcacaagaaggccacgtacgagcccgacgtggacctggggtccggcacccgcaacatcgggatcgagagcgagatccccaacctcgacatcatcggcaagcggatcgagaagatcaagcaggagcacgagacctcctggcactacgaccaggaccacccctacaagacctgggcgtaccacggcagctacgagacgaagcagaccgggtccgccagctccatggtgaacggcgtcgtgcgcctgctgaccaagccgtgggacgtgctccccaccgtcacgcagatggccatgaccgacaccacccccttcgggcagcagcgcgtgttcaaggagaaggtggacacgcggacccaggagcccaaggagggcaccaagaagctgatgaagatcaccgccgagtggctgtggaaggagctcggcaagaagaagacgccgcgcatgtgcacccgggaggagttcacccgcaaggtccggagcaacgccgcgctgggggccatcttcaccgacgagaacaagtggaagtccgcccgcgaggccgtggaggacagccggttctgggagctggtcgacaaggagcgcaacctccacctggagggcaagtgcgagacgtgcgtgtacaacatgatggggaagcgggagaagaagctgggcgagttcgggaaggccaagggctcccgcgcgatctggtacatgtggctcggcgcccggttcctggagttcgaggccctggggttcctcaacgaggaccactggttcagccgcgagaactccctgagcggcgtggagggggagggcctgcacaagctccggtacatcctgcgcgacgtcagcaagaaggagggcggggccatgtacgcggacgacaccgccggctgggacacccggatcaccctggaggacctcaagaacgaggagatggtgacgaaccacatggagggggagcacaagaagctggccgaggccatcttcaagctgacctaccagaacaaggtggtccgcgtgcagcggcccacgccccgcggcaccgtgatggacatcatctcccggcgcgaccagcgggggagcggccaggtcgggacctacggcctcaacaccttcaccaacatggaggcccagctgatccgccagatggagggcgagggggtgttcaagaacatccagcacctgaccgcgacggaggagatcgccgtgcagaactggctcgcccgcgtcggccgggagcgcctgtcccggatggccatcagcggggacgactgcgtggtgaagcccctggacgaccgcttcgcctccgcgctcaccgccctgaacgacatgggcaagatccggaaggacatccagcagtgggagccgagccgcggctggaacgactggacccaggtccccttctgctcccaccacttccacgagctgatcatgaaggacgggcgggtgctcgtggtcccctgccgcaaccaggacgagctgatcggccgggcccgcatcagccagggggccggctggtccctgcgggagaccgcctgcctcggcaagagctacgcgcagatgtggtccctgatgtacttccaccgccgggacctgcgcctcgccgccaacgccatctgcagcgccgtgccctcccactgggtgccgacgagccggaccacctggtccatccacgcgaagcacgagtggatgaccaccgaggacatgctgacggtctggaaccgcgtgtggatccaggagaacccctggatggaggacaagacccccgtggagagctgggaggagatcccctacctgggcaagcgggaggaccagtggtgcggctccctcatcgggctgaccagccgcgccacctgggccaagaacatccaggccgcgatcaaccaggtccggagcctgatcggcaacgaggagtacacggactacatgccgtccatgaagcgcttccgccgggaggaggaggaggccggggtgctctggtga

SEQ ID NO: 9806 - RNA, 9876 nt, synthetic construct
  misc_feature 1..9876: note = derived and/or modified CDS sequence (opt1) from DENV-2__AF169683__SS-prME
  source 1..9876: mol_type = other RNA
agcgcggggatgatcatcatgctgatccccaccgtgatggccttccacctcaccacccggaacggggagccccacatgatcgtcagcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaactccaccagcacctgggtgacctacgggacctgcaccaccaccggcgagcaccgccgggagaagcgctccgtcgccctggtgccccacgtgggcatggggctcgagacgcggaccgagacctggatgagctccgagggcgcctggaagcacgcccagcgcatcgagacctggatcctgcggcacccggggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgccgcatccccttcgagatcatggacctggagaagcggtacgtgctcggccgcctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccgctccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccggagcgtgacccgcctggagaacctcatgtggaagcagatcacccccgagctgaaccacatcctggccgagaacgaggtcaagctcaccatcatgacgggggacatcaagggcatcatgcacgccgggaagcggtccctgcgcccgcagcccaccgagctgaagtacagctggaagacctggggcaaggcgaagatgctctccaccgagagccacaaccagacgttcctgatcgacggccccgagaccgccgagtgcccgaacaccaaccgggcctggaactccctggaggtggaggactacgggttcggcgtgttcaccacgaacatctggctcaagctgaaggagaagcaggacgccttctgcgacagcaagctgatgtccgccgcgatcaaggacaaccgcgccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccggccggggtaccacacccagatcgccggcccctggcacctggggaagctggagatggacttcgacttctgcgacggcaccacggtggtggtcaccgaggactgcgggaaccgcggccccagcctccggaccaccacggccagcggcaagctgatcaccgagtggtgctgccgctcctgcaccctgcccccgctccggtaccgcggggaggacggctgctggtacgggatggagatccggcccctgaaggagaaggaggagaacctggtgaacagcctcgtgaccgccggccacgggcaggtcgacaacttctccctgggcgtgctgggcatggccctcttcctggaggagatgctgcgcacgcgggtggggaccaagcacgccatcctcctggtcgccgtgagcttcgtgaccctgatcaccggcaacatgtccttcaaggacctcgggcgcgtcgtggtgatggtcggcgccacgatgaccgacgacatcgggatgggcgtgacctacctggccctgctcgcggccttcaaggtgcggcccaccttcgccgccggcctgctgctccgcaagctgacgagcaaggagctgatgatgaccaccatcgggatcgtcctcctgtcccagagcaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcaccatcctggcggtggtcagcgtgagccccctgatcctcacgagctcccagcagaagaccgactggatccccctggccctgaccatcaaggggctcaaccccaccgccatcttcctgacgaccctgagccggaccaacaagaagcgctcctggccgctcaacgaggccatcatggcggtgggcatggtcagcatcctggcctccagcctgctcaagaacgacatccccatgaccggccccctggtggccgggggcctgctcacggtgtgctacgtcctgaccgggcggtccgccgacctggagctcgagcgcgccaccgacgtgaagtgggaggaccaggcggagatcagcggcagctcccccatcctgagcatcaccatctccgaggacgggagcatgtccatcaagaacgaggaggaggagcagacgctgaccatcctcatccggaccggcctgctggtgatcagcggcctcttcccggtctccatccccatcaccgccgccgcctggtacctgtgggaggtgaagaagcagcgcgccggggtgctgtgggacgtcccctccccgccgcccatgggcaaggcggagctcgaggacggggcctaccggatcaagcagaagggcatcctggggtactcccagatcggcgccggcgtgtacaaggaggggaccttccacacgatgtggcacgtgacccgcggcgccgtcctgatgcacaaggggaagcggatcgagcccagctgggccgacgtgaagaaggacctcatctcctacggcgggggctggaagctggagggcgagtggaaggagggggaggaggtgcaggtcctggcgctcgagcccggcaagaacccccgcgccgtgcagaccaagcccgggctgttcaagaccaacacgggcaccatcggggccgtgagcctggacttctcccccggcaccagcggctcccccatcatcgacaagaaggggaaggtcgtgggcctctacgggaacggcgtggtcacccggagcggcgcctacgtgtccgccatcgcgcagacggagaagtccatcgaggacaaccccgagatcgaggacgacatcttccgcaagcggcgcctgaccatcatggacctgcaccccggggccggcaagaccaagcggtacctgcccgccatcgtgcgcgaggccatcaagcgggggctccgcaccctgatcctggcgccgacgcgggtcgtggccgccgagatggaggaggccctccgcggcctgcccatccggtaccagacccccgccatccgcgcggagcacaccgggcgcgagatcgtggacctgatgtgccacgccaccttcacgatgcggctcctgtcccccgtccgcgtgccgaactacaacctgatcatcatggacgaggcccacttcaccgaccccgccagcatcgccgcgcggggctacatcagcacccgcgtggagatgggcgaggccgccgggatcttcatgaccgccacgccgcccggctcccgggacccgttcccccagagcaacgcccccatcatcgacgaggagcgcgagatccccgagcggtcctggaacagcgggcacgagtgggtcaccgacttcaagggcaagaccgtgtggttcgtgccgtccatcaaggcggggaacgacatcgccgcctgcctccgcaagaacggcaagaaggtcatccagctgagccggaagaccttcgactccgagtacgtgaagacgcgcaccaacgactgggacttcgtggtcaccaccgacatcagcgagatgggcgccaacttcaaggcggagcgggtgatcgacccccgccggtgcatgaagcccgtgatcctgacggacggggaggagcgcgtcatcctcgccggccccatgccggtgacccacttctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccggaagaccttcgtcgacctgatgcgccggggcgacctccccgtgtggctggcctacaaggtggccgcggaggggatcaactacgccgaccgccggtggtgcttcgacggcatcaagaacaaccagatcctggaggagaacgtcgaggtggagatctggacgaaggagggggagcgcaagaagctcaagccgcggtggctggacgcccgcatctactccgaccccctggccctcaaggagttcaaggagttcgccgcgggccgcaagagcctggccctgaacctcatcaccgagatgggccgcctgcccaccttcatgacccagaagacgcgggacgccctggacaacctcgccgtcctgcacaccgcggaggccgggggccgcgcctacaaccacgccctgtccgagctccccgagaccctggagaccctgctcctgctgacgctcctggccaccgtgaccgggggcatcttcctgttcctcatgagcggccgggggatcggcaagatgaccctggggatgtgctgcatcatcaccgcgtccatcctgctctggtacgcccagatccagccgcactggatcgccgccagcatcatcctggtgttcttcctgatcgtcctcctgatccccgagcccgagaagcagcgcacgccccaggacaaccagctgacctacgtggtgatcgccatcctcaccgtcgtggcggccaccatggccaacgagatgggcttcctggagaagacgaagaaggacctggggttcggctccatcgccacccagcagccggagagcaacatcctcgacatcgacctgcggcccgcctccgcgtggaccctgtacgccgtggccaccacgttcgtcacccccatgctccgccacagcatcgagaacagctccgtgaacgtgagcctgaccgccatcgccaaccaggcgaccgtcctgatgggcctcgggaagggctggcccctgtccaagatggacatcggggtgccgctgctcgccatcggctgctacagccaggtgaaccccatcacgctgaccgccgccctgctcctgctggtcgcgcactacgccatcatcgggcccggcctccaggccaaggccacccgggaggcccagaagcgcgcggccgccggcatcatgaagaaccccaccgtggacgggatcacggtgatcgacctggacccgatcccctacgaccccaagttcgagaagcagctgggccaggtcatgctcctggtgctgtgcgtgacccaggtcctcatgatgcggaccacctgggccctgtgcgaggccctgacgctcgcgaccgggcccatctccaccctgtgggagggcaacccggggcgcttctggaacaccacgatcgccgtgagcatggccaacatcttccggggctcctacctggccggcgccgggctcctgttcagcatcatgaagaacaccaccaacacccgccgcggcacggggaacatcggcgagaccctgggcgagaagtggaagtcccggctcaacgcgctgggcaagagcgagtcccagatctacaagaagtccggcatccaggaggtggaccgcaccctggccaaggaggggatcaagcggggcgagaccgaccaccacgccgtctcccgcgggagcgccaagctccggtggttcgtggagcgcaacatggtgacgcccgagggcaaggtcgtggacctgggctgcgggcggggcgggtggtcctactactgcggcgggatcaagaacgtgcgcgaggtcaagggcctgaccaagggcgggcccggccacgaggagcccatcccgatgagcacctacgggtggaacctcgtgcggctgcagtccggcgtggacgtcttcttcatcccgcccgagaagtgcgacaccctgctctgcgacatcggggagagctcccccaacccgacggtggaggcgggccgcaccctgcgggtgctgaacctcgtcgagaactggctgaacaacaacacccagttctgcatcaaggtgctgaacccctacatgcccagcgtgatcgagaagatggaggccctccagcgcaagtacggcggggccctggtccggaacccgctgagccgcaactccacccacgagatgtactgggtgagcaacgcctccggcaacatcgtgagctccgtcaacatgatcagccggatgctgatcaaccgcttcaccatgcggcacaagaaggccacgtacgagcccgacgtggacctcgggtccggcacccgcaacatcgggatcgagagcgagatccccaacctggacatcatcggcaagcggatcgagaagatcaagcaggagcacgagacctcctggcactacgaccaggaccacccctacaagacctgggcgtaccacggcagctacgagacgaagcagaccgggtccgccagctccatggtgaacggcgtcgtgcgcctgctcaccaagccgtgggacgtgctgcccaccgtcacgcagatggccatgaccgacaccacccccttcgggcagcagcgcgtgttcaaggagaaggtggacacgcggacccaggagcccaaggagggcaccaagaagctgatgaagatcaccgccgagtggctctggaaggagctgggcaagaagaagacgccgcgcatgtgcacccgggaggagttcacccgcaaggtccggagcaacgccgcgctgggggccatcttcaccgacgagaacaagtggaagtccgcccgcgaggccgtggaggacagccggttctgggagctcgtcgacaaggagcgcaacctgcacctggagggcaagtgcgagacgtgcgtgtacaacatgatggggaagcgggagaagaagctcggcgagttcgggaaggccaagggctcccgcgcgatctggtacatgtggctgggcgcccggttcctggagttcgaggccctcgggttcctgaacgaggaccactggttcagccgcgagaactccctgagcggcctcgagggggagggcctgcacaagctggggtacatcctccgggacgtgagcaagaaggagggcggcgccatgtacgcggacgacaccgccgggtgggacacccgcatcaccctggaggacctgaagaacgaggagatggtcacgaaccacatggagggcgagcacaagaagctcgccgaggccatcttcaagctgacctaccagaacaaggtggtgcgggtccagcgccccacgccccgggggaccgtgatggacatcatctcccgccgggaccagcgcggcagcggccaggtgggcacgtacggcctgaacaccttcaccaacatggaggcccagctcatccggcagatggagggggagggcgtcttcaagaacatccagcacctgaccgcgacggaggagatcgccgtgcagaactggctggcccgcgtggggcgcgagcggctctcccgcatggccatcagcggcgacgactgcgtcgtgaagcccctggacgaccggttcgcctccgcgctgaccgccctcaacgacatgggcaagatccgcaaggacatccagcagtgggagccgagccgggggtggaacgactggacccaggtgcccttctgctcccaccacttccacgagctgatcatgaaggacggccgcgtcctggtggtgccctgccggaaccaggacgagctcatcgggcgcgcccggatcagccagggcgccgggtggtccctgcgcgagaccgcctgcctgggcaagagctacgcgcagatgtggtccctcatgtacttccaccggcgcgacctgcggctggccgccaacgccatctgcagcgccgtcccctcccactgggtgccgacgagccgcaccacctggtccatccacgcgaagcacgagtggatgaccaccgaggacatgctcacggtgtggaaccgggtctggatccaggagaacccctggatggaggacaagacccccgtggagagctgggaggagatcccctacctgggcaagcgcgaggaccagtggtgcgggtccctgatcggcctcaccagccgggccacctgggccaagaacatccaggccgcgatcaaccaggtgcgcagcctgatcgggaacgaggagtacacggactacatgccgtccatgaagcggttccgccgcgaggaggaggaggccggcgtcctgtggtga

SEQ ID NO: 9807 - RNA, 9876 nt, synthetic construct
  misc_feature 1..9876: note = derived and/or modified CDS sequence (opt1) from DENV-2__AF169684__SS-prME
  source 1..9876: mol_type = other RNA
agcgccggcatgatcatcatgctgatccccaccgtgatggccttccacctcaccacccggaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaactccaccagcacctgggtgacctacgggacctgcaccaccaccggcgagcaccggcgggagaagcggtccgtcgccctggtgccccacgtgggcatggggctcgagacgcggaccgagacctggatgagctccgagggcgcctggaagcacgcccagcggatcgagacctggatcctgcggcacccggggttcacgatcatggccgcgatcctggcctacaccatcggcaccacccacttccagcgggccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgccgcatccccttcgagatcatggacctggagaagcggtacgtgctcggccgcctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccgctccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccggagcgtgacccgcctggagaacctcatgtggaagcagatcacccccgagctgaaccacatcctggccgagaacgaggtcaagctcaccatcatgacgggggacatcaagggcatcatgcaggccgggaagcggtccctgcgcccgcagcccaccgagctgaagtacagctggaagacctggggcaaggcgaagatgctctccaccgagagccacaaccagacgttcctgatcgacggccccgagaccgccgagtgcccgaacaccaaccgggcctggaactccctggaggtggaggactacgggttcggcgtgttcaccacgaacatctggctcaagctgaaggagaagcaggacgccttctgcgacagcaagctgatgtccgccgcgatcaaggacaaccgcgccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccggccggggtaccacacccagatcgccggcccctggcacctggggaagctggagatggacttcgacttctgcgacggcaccacggtggtggtcaccgaggactgcgggaaccgcggccccagcctccggaccaccacggccagcggcaagctgatcaccgagtggtgctgccgctcctgcaccctgcccccgctccggtaccgcggggaggacggctgctggtacgggatggagatccggcccctgaaggagaaggaggagaacctggtgaacagcctcgtgaccgccggccacgggcaggtcgacaacttctccctgggcgtgctgggcatggccctcttcctggaggagatgctgcgcacgcgggtggggaccaagcacgccatcctcctggtcgccgtgagcttcgtgaccctgatcaccggcaacatgtccttcaaggacctcgggcgcgtcgtggtgatggtcggcgccacgatgaccgacgacatcgggatgggcgtgacctacctggccctgctcgcggccttcaaggtgcggcccaccttcgccgccggcctgctgctccgcaagctgacgagcaaggagctgatgatgaccaccatcgggatcgtcctcctgtcccagagcaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcaccatcctggcggtggtcagcgtgagccccctgatcctcacgagctcccagcagaagaccgactggatccccctggccctgaccatcaaggggctcaaccccaccgccatcttcctgacgaccctgagccggaccaacaagaagcgctcctggccgctcaacgaggccatcatggcggtgggcatggtcagcatcctggcctccagcctgctcaagaacgacatccccatgaccggccccctggtggccgggggcctgctcacggtgtgctacgtcctgaccgggcggtccgccgacctggagctcgagcgcgccaccgacgtgaagtgggaggaccaggcggagatcagccggagctcccccatcctgagcatcaccatctccgaggacggcagcatgtccatcaagaacgaggaggaggagcagacgctgaccatcctcatccgcaccgggctgctggtgatcagcggcctcttcccggtctccatccccatcaccgccgccgcctggtacctgtgggaggtgaagaagcagcgggccggcgtgctgtgggacgtcccctccccgccgcccatggggaaggcggagctcgaggacggcgcctaccgcatcaagcagaaggggatcctgggctactcccagatcggggccggcgtgtacaaggagggcaccttccacacgatgtggcacgtgacccgcggggcggtcctgatgcacaagggcaagcgcatcgagcccagctgggccgacgtgaagaaggacctcatctcctacgggggcgggtggaagctggagggcgagtggaaggagggcgaggaggtgcaggtcctggcgctcgagcccgggaagaacccccgggccgtgcagaccaagcccggcctgttcaagaccaacacggggaccatcggcgccgtgagcctggacttctcccccgggaccagcggctcccccatcatcgacaagaagggcaaggtcgtggggctctacggcaacggggtggtcacccgcagcggcgcctacgtgtccgccatcgcgcagacggagaagtccatcgaggacaaccccgagatcgaggacgacatcttccggaagcgccggctgaccatcatggacctgcaccccggcgccgggaagaccaagaagtacctgcccgccatcgtgcgcgaggccatcaagcggggcctccgcaccctgatcctggcgccgacgcgggtcgtggccgccgagatggaggaggccctccgcgggctgcccatccggtaccagacccccgccatccgcgcggagcacaccggccgcgagatcgtggacctgatgtgccacgccaccttcacgatgcggctcctgtcccccgtccgcgtgccgaactacaacctgatcatcatggacgaggcccacttcaccgaccccgccagcatcgccgcgcgggggtacatcagcacccgcgtggagatgggcgaggccgccggcatcttcatgaccgccacgccgcccgggtcccgggacccgttcccccagagcaacgcccccatcatcgacgaggagcgcgagatccccgagcggtcctggaacagcggccacgagtgggtcaccgacttcaaggggaagaccgtgtggttcgtgccgtccatcaaggcgggcaacgacatcgccgcctgcctccgcaagaacgggaagaaggtcatccagctgagccggaagaccttcgactccgagtacgtgaagacgcgcaccaacgactgggacttcgtggtcaccaccgacatcagcgagatgggcgccaacttcaaggcggagcgggtgatcgacccccgccggtgcatgaagcccgtgatcctgacggacggcgaggagcgcgtcatcctcgccgggcccatgccggtgacccacttctccgccgcccagcggcgcggccggatcgggcgcaaccccaagaacgagaacgaccagtacatctacatgggcgagcccctggagaacgacgaggactgcgcccactggaaggaggcgaagatgctgctcgacaacatcaacacccccgaggggatcatcccgagcatgttcgagcccgagcgggagaaggtggacgccatcgacggcgagtaccgcctgcgcggcgaggcccggaagaccttcgtcgacctgatgcgccgcggggacctccccgtgtggctggcctacaaggtggccgcggagggcatcaactacgccgaccgccggtggtgcttcgacgggatcaagaacaaccagatcctggaggagaacgtcgaggtggagatctggacgaaggagggcgagcgcaagaagctcaagccgcggtggctggacgcccgcatctactccgaccccctggccctcaaggagttcaaggagttcgccgcggggcgcaagagcctggccctgaacctcatcaccgagatgggccgcctgcccaccttcatgacccagaagacgcgggacgccctggacaacctcgccgtcctgcacaccgcggaggccggcgggcgcgcctacaaccacgccctgtccgagctccccgagaccctggagaccctgctcctgctgacgctcctggccaccgtgaccggcgggatcttcctgttcctcatgagcggccggggcatcgggaagatgaccctgggcatgtgctgcatcatcaccgcgtccatcctgctctggtacgcccagatccagccgcactggatcgccgccagcatcatcctggagttcttcctgatcttcctcctgatccccgagcccgagaagcagcgcacgccccaggacaaccagctgacctacgtggtcatcgccatcctcaccgtggtggcggccaccatggccaacgagatggggttcctggagaagacgaagaaggacctgggcttcgggtccatcgccacccagcagccggagagcaacatcctcgacatcgacctgcggcccgcctccgcgtggaccctgtacgccgtcgccaccacgttcgtgacccccatgctccgccacagcatcgagaacagctccgtgaacgtcagcctgaccgccatcgccaaccaggcgaccgtgctgatgggcctcggcaaggggtggcccctgtccaagatggacatcggcgtgccgctgctcgccatcgggtgctacagccaggtcaaccccatcacgctgaccgccgccctgctcctgctggtggcgcactacgccatcatcggccccgggctccaggccaaggccacccgggaggcccagaagcgcgcggccgccggcatcatgaagaaccccaccgtggacggcatcacggtcatcgacctggacccgatcccctacgaccccaagttcgagaagcagctgggccaggtgatgctcctggtgctgtgcgtcacccaggtgctcatgatgcggaccacctgggccctgtgcgaggccctgacgctcgcgaccggccccatctccaccctgtgggaggggaacccgggccgcttctggaacaccacgatcgccgtgagcatggccaacatcttccgggggtcctacctggccggcgccggcctcctgttcagcatcatgaagaacaccaccaacacccgccgcgggacgggcaacatcggggagaccctgggcgagaagtggaagtcccggctcaacgcgctgggcaagagcgagttccagatctacaagaagtccgggatccaggaggtcgaccgcaccctggccaaggagggcatcaagcgcggggagaccgaccaccacgccgtgagccgcggctccgccaagctccggtggttcgtggagcgcaacatggtcacgcccgaggggaaggtggtggacctgggctgcggccgcggcgggtggagctactactgcggcgggctgaagaacgtccgcgaggtgaaggggctcaccaagggcgggcccgggcacgaggagcccatcccgatgtccacctacggctggaacctggtgcggctgcagagcggggtcgacgtgttcttcatcccgcccgagaagtgcgacaccctcctgtgcgacatcggcgagtccagccccaacccgacggtggaggcggggcgcaccctgcgggtcctcaacctggtggagaactggctgaacaacaacacccagttctgcatcaaggtgctcaacccctacatgccctccgtcatcgagaagatggaggccctgcagcgccggtacggcggcgccctggtgcgcaacccgctgagccggaacagcacccacgagatgtactgggtgtccaacgccagcgggaacatcgtctccagcgtgaacatgatctcccgcatgctcatcaaccggttcaccatgaagcacaagaaggccacgtacgagcccgacgtggacctgggcagcgggacccgcaacatcggcatcgagtccgaggtccccaacctggacatcatcgggaagcggatcgagaagatcaagcaggagcacgagaccagctggcactacgaccaggaccacccctacaagacctgggcgtaccacggctcctacgagacgaagcagaccggcagcgcctccagcatggtgaacggggtggtccgcctcctgaccaagccgtgggacgtgctgcccaccgtgacgcagatggccatgaccgacaccacccccttcggccagcagcgcgtcttcaaggagaaggtggacacgcggacccaggagcccaaggaggggaccaagaagctcatgaagatcaccgccgagtggctgtggaaggagctgggcaagaagaagacgccgcgcatgtgcacccgggaggagttcacccgcaaggtgcggtccaacgccgcgctcggcgccatcttcaccgacgagaacaagtggaagtccgcccgcgaggccgtcgaggactcccggttctgggagctggtggacaaggagcgcaacctgcacctcgaggggaagtgcgagacgtgcgtctacaacatgatgggcaagcgggagaagaagctgggggagttcggcaaggccaaggggagccgcgcgatctggtacatgtggctgggcgcccggttcctcgagttcgaggccctgggcttcctgaacgaggaccactggttctcccgcgagaacagcctctccggggtggagggcgaggggctgcacaagctgggctacatcctccgggacgtgagcaagaaggagggcggggccatgtacgcggacgacaccgccggctgggacacccgcatcaccctggaggacctgaagaacgaggagatggtcacgaaccacatggagggggagcacaagaagctcgccgaggccatcttcaagctgacctaccagaacaaggtggtgcgggtccagcgccccacgccccggggcaccgtgatggacatcatcagccgccgggaccagcgcgggtccggccaggtggggacgtacggcctgaacaccttcaccaacatggaggcccagctcatccggcagatggagggcgagggggtcttcaagaacatccagcacctgaccgcgacggaggagatcgccgtgcagaactggctggcccgcgtgggccgcgagcggctcagccgcatggccatctccggggacgactgcgtcgtgaagcccctggacgaccggttcgccagcgcgctgaccgccctcaacgacatgggcaagatccgcaaggacatccagcagtgggagccgtcccggggctggaacgactggacccaggtgcccttctgcagccaccacttccacgagctgatcatgaaggacgggcgcgtcctggtggtgccctgccggaaccaggacgagctcatcggccgcgcccggatctcccagggggccggctggagcctgcgcgagaccgcctgcctggggaagtcctacgcgcagatgtggagcctcatgtacttccaccggcgcgacctgcggctggccgccaacgccatctgctccgccgtccccagccactgggtgccgacgtcccgcaccacctggagcatccacgcgaagcacgagtggatgaccaccgaggacatgctcacggtgtggaaccgggtctggatccaggagaacccctggatggaggacaagacccccgtggagtcctgggaggagatcccctacctgggcaagcgcgaggaccagtggtgcggcagcctgatcgggctcacctcccgggccacctgggccaagaacatccaggccgcgatcaaccaggtgcgcagcctgatcggcaacgaggagtacacggactacatgccgagcatgaagcggttccgccgcgaggaggaggaggccggggtcctgtggtga

SEQ ID NO: 9808 - RNA, 9876 nt, synthetic construct
  misc_feature 1..9876: note = derived and/or modified CDS sequence (opt1) from DENV-2__AF169685__SS-prME
  source 1..9876: mol_type = other RNA
agcgcggggatgatcatcatgctgatccccaccgtgatggccttccacctcaccacccgcaacggggagccccacatgatcgtcagcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaactccaccagcacctgggtgacctacgggacctgcaccaccaccggcgagcaccgccgggagaagcgctccgtcgccctggtgccccacgtgggcatggggctcgagacgcggaccgagacctggatgagctccgagggcgcctggaagcacgcccagcgcatcgagacctggatcctgcggcacccggggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgccgcatccccttcgagatcatggacctggagaagcggtacgtgctcggccgcctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccgctccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccggagcgtgacccgcctggagaacctcatgtggaagcagatcacccccgagctgaaccacatcctggccgagaacgaggtcaagctcaccatcatgacgggggacatcaagggcatcatgcaggccgggaagcggtccctgcgcccgcagcccaccgagctgaagtacagctggaagacctggggcaaggcgaagatgctctccaccgagagccacaaccagacgttcctgatcgacggccccgagaccgccgagtgcccgaacaccaaccgggcctggaactccctggaggtggaggactacgggttcggcgtgttcaccacgaacatctggctcaagctgaaggagaagcaggacgccttctgcgacagcaagctgatgtccgccgcgatcaaggacaaccgcgccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccggccggggtaccacacccagatcgccggcccctggcacctggggaagctggagatggacttcgacttctgcgacggcaccacggtggtggtcaccgaggactgcgggaaccgcggccccagcctccggaccaccacggccagcggcaagctgatcaccgagtggtgctgccgctcctgcaccctgcccccgctccggtaccgcggggaggacggctgctggtacgggatggagatccggcccctgaaggagaaggaggagaacctggtgaacagcctcgtgaccgccggccacgggcaggtcgacaacttctccctgggcgtgctgggcatggccctcttcctggaggagatgctgcgcacgcgggtggggaccaagcacgccatcctcctggtcgccgtgagcttcgtgaccctgatcaccggcaacatgtccttcaaggacctcgggcgcgtcgtggtgatggtcggcgccacgatgaccgacgacatcgggatgggcgtgacctacctggccctgctcgcggccttcaaggtgcggcccaccttcgccgccggcctgctgctccgcaagctgacgagcaaggagctgatgatgaccaccatcgggatcgtcctcctgtcccagagcaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcaccatcctggcggtggtcagcgtgagccccctgatcctcacgagctcccagcagaagaccgactggatccccctggccctgaccatcaaggggctcaaccccaccgccatcttcctgacgaccctgagccggaccaacaagaagcgctcctggccgctcaacgaggccatcatggcggtgggcatggtcagcatcctggcctccagcctgctcaagaacgacatccccatgaccggccccctggtggccgggggcctgctcacggtgtgctacgtcctgaccgggcggtccgccgacctggagctcgagcgcgccaccgacgtgaagtgggaggaccaggcggagatcagcggcagctcccccatcctgagcatcaccatctccgaggacgggagcatgtccatcaagaacgaggaggaggagcagacgctgaccatcctcatccggaccggcctgctggtgatcagcggcctcttcccggtctccatccccatcaccgccgccgcctggtacctgtgggaggtgaagaagcagcgcgccggggtgctgtgggacgtcccctccccgccgcccatgggcaaggcggagctcgaggacggggcctaccggatcaagcagaagggcatcctggggtactcccagatcggcgccggcgtgtacaaggaggggaccttccacacgatgtggcacgtgacccgcggcgccgtcctgatgcacaaggggaagcggatcgagcccagctgggccgacgtgaagaaggacctcatctcctacggcgggggctggaagctggagggcgagtggaaggagggggaggaggtgcaggtcctggcgctcgagcccggcaagaacccccgcgccgtgcagaccaagcccgggctgttcaagaccaacacgggcaccatcggggccgtgagcctggacttctcccccggcaccagcggctcccccatcatcgacaagaaggggaaggtcgtgggcctctacgggaacggcgtggtcacccggagcggcgcctacgtgtccgccatcgcgcagacggagaagtccatcgaggacaaccccgagatcgaggacgacatcttccgcaagcggcgcctgaccatcatggacctgcaccccggggccggcaagaccaagcggtacctgcccgccatcgtgcgcgaggccatcaagcgggggctccgcaccctgatcctggcgccgacgcgggtcgtggccgccgagatggaggaggccctccgcggcctgcccatccggtaccagacccccgccatccgcgcggagcacaccgggcgcgagatcgtggacctgatgtgccacgccaccttcacgatgcggctcctgtcccccgtccgcgtgccgaactacaacctgatcatcatggacgaggcccacttcaccgaccccgccagcatcgccgcgcggggctacatcagcacccgcgtggagatgggcgaggccgccgggatcttcatgaccgccacgccgcccggctcccgggacccgttcccccagagcaacgcccccatcatcgacgaggagcgcgagatccccgagcggtcctggaacagcgggcacgagtgggtcaccgacttcaagggcaagaccgtgtggttcgtgccgtccatcaaggcggggaacgacatcgccgcctgcctccgcaagaacggcaagaaggtcatccagctgagccggaagaccttcgactccgagtacgtgaagacgcgcaccaacgactgggacttcgtggtcaccaccgacatcagcgagatgggcgccaacttcaaggcggagcgggtgatcgacccccgccggtgcatgaagcccgtgatcctgacggacggggaggagcgcgtcatcctcgccggccccatgccggtgacccacttctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccggaagaccttcgtcgacctgatgcgccggggcgacctccccgtgtggctggcctacaaggtggccgcggaggggatcaactacgccgaccgccggtggtgcttcgacggcatcaagaacaaccagatcctggaggagaacgtcgaggtggagatctggacgaaggagggggagcgcaagaagctcaagccgcggtggctggacgcccgcatctactccgaccccctggccctcaaggagttcaaggagttcgccgcgggccgcaagagcctggccctgaacctcatcaccgagatgggccgcctgcccaccttcatgacccagaagacgcgggacgccctggacaacctcgccgtcctgcacaccgcggaggccgggggccgcgcctacaaccacgccctgtccgagctccccgagaccctggagaccctgctcctgctgacgctcctggccaccgtgaccgggggcatcttcctgttcctcatgagcggccgggggatcggcaagatgaccctggggatgtgctgcatcatcaccgcgtccatcctgctctggtacgcccagatccagccgcactggatcgccgccagcatcatcctggtgttcttcctgatcgtcctcctgatccccgagcccgagaagcagcgcacgccccaggacaaccagctgacctacgtggtgatcgccatcctcaccgtcgtggcggccaccatggccaacgagatgggcttcctggagaagacgaagaaggacctggggttcggctccatcgccacccagcagccggagagcaacatcctcgacatcgacctgcggcccgcctccgcgtggaccctgtacgccgtggccaccacgttcgtcacccccatgctccgccacagcatcgagaacagctccgtgaacgtgagcctgaccgccatcgccaaccaggcgaccgtcctgatgggcctcgggaagggctggcccctgtccaagatggacatcggggtgccgctgctcgccatcggctgctacagccaggtgaaccccatcacgctgaccgccgccctgctcctgctggtcgcgcactacgccatcatcgggcccggcctccaggccaaggccacccgggaggcccagaagcgcgcggccgccggcatcatgaagaaccccaccgtggacgggatcacggtgatcgacctggacccgatcccctacgaccccaagttcgagaagcagctgggccaggtcatgctcctggtgctgtgcgtgacccaggtcctcatgatgcggaccacctgggccctgtgcgaggccctgacgctcgcgaccgggcccatctccaccctgtgggagggcaacccggggcgcttctggaacaccacgatcgccgtgagcatggccaacatcttccggggctcctacctggccggcgccgggctcctgttcagcatcatgaagaacaccaccaacacccgccgcggcacggggaacatcggcgagaccctgggcgagaagtggaagtcccggctcaacgcgctgggcaagagcgagttccagatctacaagaagtccggcatccaggaggtggaccgcaccctggccaaggaggggatcaagcggggcgagaccgaccaccacgccgtcagccgcgggtccgccaagctccggtggttcgtggagcgcaacatggtgacgcccgagggcaaggtcgtggacctgggctgcgggcggggcgggtggagctactactgcggcgggctgaagaacgtgcgcgaggtcaagggcctcaccaagggcgggcccggccacgaggagcccatcccgatgtccacctacgggtggaacctggtgcggctgcagagcggcgtggacgtcttcttcatcccgcccgagaagtgcgacaccctcctgtgcgacatcggggagtccagccccaacccgacggtggaggcgggccgcaccctgcgggtgctcaacctggtcgagaactggctgaacaacaacacccagttctgcatcaaggtgctcaacccctacatgccctccgtgatcgagaagatggaggccctgcagcgccggtacggcggggccctggtccgcaacccgctgagccggaacagcacccacgagatgtactgggtgtccaacgccagcggcaacatcgtgtccagcgtcaacatgatctcccgcatgctcatcaaccggttcaccatgcgccacaagaaggccacgtacgagcccgacgtggacctggggagcggcacccggaacatcgggatcgagtccgaggtgcccaacctggacatcatcggcaagcgcatcgagaagatcaagcaggagcacgagaccagctggcactacgaccaggaccacccctacaagacctgggcgtaccacggctcctacgagacgaagcagaccgggagcgcctccagcatggtcaacggcgtggtgcgcctcctgaccaagccgtgggacgtcctgcccaccgtgacgcagatggccatgaccgacaccacccccttcgggcagcagcgggtgttcaaggagaaggtcgacacgcgcacccaggagcccaaggagggcaccaagaagctcatgaagatcaccgccgagtggctgtggaaggagctgggcaagaagaagacgccgcggatgtgcacccgcgaggagttcacccggaaggtgcgctccaacgccgcgctcggggccatcttcaccgacgagaacaagtggaagtccgcccgggaggccgtcgaggactcccgcttctgggagctggtggacaaggagcggaacctgcacctcgagggcaagtgcgagacgtgcgtgtacaacatgatggggaagcgcgagaagaagctgggcgagttcgggaaggccaagggcagccgggcgatctggtacatgtggctgggcgcccgcttcctcgagttcgaggccctggggttcctgaacgaggaccactggttctcccgggagaacagcctctccggcgtcgagggggagggcctgcacaagctggggtacatcctccgcgacgtgagcaagaaggagggcggcgccatgtacgcggacgacaccgccgggtgggacacccggatcaccctggaggacctgaagaacgaggagatggtgacgaaccacatggagggcgagcacaagaagctcgccgaggccatcttcaagctgacctaccagaacaaggtcgtgcgcgtgcagcggcccacgccccgggggaccgtcatggacatcatcagccggcgcgaccagcggggctccggccaggtgggcacgtacggcctgaacaccttcaccaacatggaggcccagctcatccgccagatggagggggagggcgtgttcaagaacatccagcacctgaccgcgacggaggagatcgccgtccagaactggctggcccgcgtggggcgggagcgcctcagccggatggccatctccggcgacgactgcgtggtcaagcccctggacgaccgcttcgccagcgcgctgaccgccctcaacgacatgggcaagatccggaaggacatccagcagtgggagccgtcccgcgggtggaacgactggacccaggtgcccttctgcagccaccacttccacgagctgatcatgaaggacggccgggtgctggtcgtgccctgccgcaaccaggacgagctcatcgggcgggcccgcatctcccagggcgccgggtggagcctgcgggagaccgcctgcctgggcaagtcctacgcgcagatgtggagcctcatgtacttccaccgccgggacctgcgcctggccgccaacgccatctgctccgccgtgcccagccactgggtcccgacgtcccggaccacctggagcatccacgcgaagcacgagtggatgaccaccgaggacatgctcacggtgtggaaccgcgtgtggatccaggagaacccctggatggaggacaagacccccgtcgagtcctgggaggagatcccctacctgggcaagcgggaggaccagtggtgcgggagcctgatcggcctcacctcccgcgccacctgggccaagaacatccaggccgcgatcaaccaggtgcggagcctgatcgggaacgaggagtacacggactacatgccgagcatgaagcgcttccgccgggaggaggaggaggccggcgtgctgtggtga

SEQ ID NO: 9809 - RNA, 9876 nt, synthetic construct
  misc_feature 1..9876: note = derived and/or modified CDS sequence (opt1) from DENV-2__AF169686__SS-prME
  source 1..9876: mol_type = other RNA
agcgccgggatgatcatcatgctgatccccaccgtgatggccttccacctcaccacccgcaacggggagccccacatgatcgtcagcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaactccaccagcacctgggtgacctacgggacgtgcaccaccaccggcgagcaccgccgggagaagcgctccgtcgccctggtgccccacgtgggcatggggctcgagacgcggaccgagacctggatgagctccgagggcgcctggaagcacgcccagcgcatcgagacctggatcctgcggcaccccgggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgcccgacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgccgcatccccttcgagatcatggacctggagaagcggtacgtgctcggccgcctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtgttcggggcgatctacggcgccgccttcagcggcgtctcctggaccatgaagatcttcatcggggtgatcatcacctggatcggcatgaacagccgctccacgagcctgtccgtgagcctggtcctggtggggatcgtgaccctctacctgggcgtcatggtgcaggccgactccgggtgcgtggtcagctggaagaacaaggagctgaagtgcggcagcggcatcttcatcaccgacaacgtgcacacctggacggagcagtacaagttccagcccgagtcccccagcaagctcgcgtccgccatccagaaggcccaggaggaggggatctgcggcatccggagcgtgacccgcctggagaacctgatgtggaagcagatcacccccgagctcaaccacatcctggccgagaacgaggtcaagctgaccatcatgacgggggacatcaagggcatcatgcaggccgggaagcggtccctccgcccgcagcccaccgagctgaagtacagctggaagacctggggcaaggcgaagatgctgtccaccgagagccacaaccagacgttcctcatcgacggccccgagaccgccgagtgcccgaacaccaaccgggcctggaactccctggaggtggaggactacgggttcggcgtgttcaccacgaacatctggctgaagctcaaggagaagcaggacgccttctgcgacagcaagctgatgtccgccgcgatcaaggacaaccgcgccgtccacgccgacatggggtactggatcgagagcgccctgaacgacacctggaagatcgagaaggcctccttcatcgaggtgaagaactgccactggcccaagagccacaccctctggtccaacggcgtgctggagagcgagatgatcatccccaagaacctggcgggccccgtctcccagcacaactaccggccggggtaccacacccagatcgccggcccctggcacctcgggaagctggagatggacttcgacttctgcgacggcaccacggtggtggtcaccgaggactgcgggaaccgcggccccagcctgcggaccaccacggccagcggcaagctcatcaccgagtggtgctgccgctcctgcaccctgcccccgctgcggtaccgcggggaggacggctgctggtacgggatggagatccggcccctcaaggagaaggaggagaacctggtgaacagcctggtgaccgccggccacgggcaggtcgacaacttctccctcggcgtgctgggcatggcgctgttcctcgaggagatgctgcgcacgcgggtggggaccaagcacgccatcctgctcgtcgccgtgagcttcgtgaccctgatcaccggcaacatgtccttcaaggacctggggcgcgtcgtggtgatggtcggcgccacgatgaccgacgacatcgggatgggcgtgacctacctcgccctgctggcggccttcaaggtgcggcccaccttcgccgccggcctcctgctgcgcaagctcacgagcaaggagctgatgatgaccaccatcgggatcgtcctgctctcccagagcaccatccccgagacgatcctggagctgaccgacgccctcgcgctgggcatgatggtgctgaagatcgtgcgcaacatggagaagtaccagctcgccgtcaccatcatggccatcctgtgcgtgccgaacgccgtcatcctgcagaacgcctggaaggtgtcctgcaccatcctcgcggtggtcagcgtgagccccctgatcctgacgagctcccagcagaagaccgactggatccccctcgccctgaccatcaaggggctgaaccccaccgccatcttcctcacgaccctgagccggaccaacaagaagcgctcctggccggtgaacgaggccatcatggcggtcggcatggtgagcatcctggcctccagcctcctgaagaacgacatccccatgaccggccccctggtggccgggggcctcctgacggtctgctacgtgctgaccgggcggtccgccgacctcgagctggagcgcgccaccgacgtgaagtgggaggaccaggcggagatcagcggcagctcccccatcctgagcatcaccatctccgaggacgggagcatgtccatcaagaacgaggaggaggagcagacgctcaccatcctgatccggaccggcctgctcgtcatcagcggcctgttcccggtgtccatccccatcaccgccgccgcctggtacctgtgggaggtgaagaagcagcgcgccggggtcctctgggacgtgccctccccgccgcccatgggcaaggcggagctggaggacggggcctaccggatcaagcagaagggcatcctggggtactcccagatcggcgccggcgtgtacaaggaggggaccttccacacgatgtggcacgtcacccgcggcgccgtgctcatgcacaaggggaagcggatcgagcccagctgggccgacgtgaagaaggacctgatctcctacggcgggggctggaagctggagggcgagtggaaggagggggaggaggtccaggtgctcgcgctggagcccggcaagaacccccgcgccgtgcagaccaagcccgggctgttcaagaccaacacgggcaccatcggggccgtcagcctcgacttctcccccggcaccagcggctcccccatcatcgacaagaaggggaaggtggtgggcctgtacgggaacggcgtcgtgacccggagcggcgcctacgtgtccgccatcgcgcagacggagaagtccatcgaggacaaccccgagatcgaggacgacatcttccgcaagcggcgcctgaccatcatggacctccaccccggggccggcaagaccaagaagtacctgcccgccatcgtccgggaggccatcaagcgcgggctgcggaccctgatcctcgcgccgacgcgcgtggtggccgccgagatggaggaggccctgcggggcctgcccatccgctaccagacccccgccatccgggcggagcacaccgggcgcgagatcgtcgacctcatgtgccacgccaccttcacgatgcgcctgctgtcccccgtgcgggtgccgaactacaacctcatcatcatggacgaggcccacttcaccgaccccgccagcatcgccgcgcgcggctacatcagcacccgggtcgagatgggcgaggccgccgggatcttcatgaccgccacgccgcccggctcccgcgacccgttcccccagagcaacgcccccatcatcgacgaggagcgggagatccccgagcgctcctggaacagcgggcacgagtgggtgaccgacttcaagggcaagaccgtgtggttcgtcccgtccatcaaggcggggaacgacatcgccgcctgcctgcggaagaacggcaagaaggtgatccagctgagccgcaagaccttcgactccgagtacgtgaagacgcggaccaacgactgggacttcgtcgtgaccaccgacatcagcgagatgggcgccaacttcaaggcggagcgcgtgatcgacccccggcgctgcatgaagcccgtcatcctcacggacggggaggagcgggtgatcctggccggccccatgccggtgacccacttctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgagatctggacgaaggagggggagcggaagaagctgaagccgcgctggctggacgcccggatctactccgaccccctcgccctgaaggagttcaaggagttcgccgcgggccgcaagagcctggccctcaacctgatcaccgagatgggccggctgcccaccttcatgacccagaagacgcgcgacgccctcgacaacctggccgtgctgcacaccgcggaggccgggggccgggcctacaaccacgccctctccgagctgcccgagaccctggagaccctcctgctgctcacgctgctggccaccgtgaccgggggcatcttcctcttcctgatgagcggccgcgggatcggcaagatgaccctggggatgtgctgcatcatcaccgcgtccatcctcctgtggtacgcccagatccagccgcactggatcgccgccagcatcatcctggtcttcttcctcatcgtgctgctgatccccgagcccgagaagcagcggacgccccaggacaaccagctcacctacgtggtcatcgccatcctgaccgtggtggcggccaccatggccaacgagatgggcttcctggagaagacgaagaaggacctcgggttcggctccatcgccacccagcagccggagagcaacatcctggacatcgacctgcgccccgcctccgcgtggaccctctacgccgtcgccaccacgttcgtgacccccatgctgcggcacagcatcgagaacagctccgtgaacgtcagcctgaccgccatcgccaaccaggcgaccgtgctcatgggcctggggaagggctggcccctgtccaagatggacatcggggtgccgctcctggccatcggctgctacagccaggtcaaccccatcacgctgaccgccgccctcctgctgctcgtggcgcactacgccatcatcgggcccggcctgcaggccaaggccacccgcgaggcccagaagcgggcggccgccggcatcatgaagaaccccaccgtggacgggatcacggtcatcgacctggacccgatcccctacgaccccaagttcgagaagcagctcggccaggtgatgctgctggtgctctgcgtcacccaggtgctgatgatgcgcaccacctgggccctgtgcgaggccctcacgctggcgaccgggcccatctccaccctgtgggagggcaacccggggcggttctggaacaccacgatcgccgtgagcatggccaacatcttccgcggctcctacctcgccggcgccgggctgctgttcagcatcatgaagaacaccaccaacacccggcgcggcacggggaacatcggcgagaccctcggcgagaagtggaagtcccgcctgaacgcgctgggcaagagcgagttccagatctacaagaagtccggcatccaggaggtcgaccggaccctcgccaaggaggggatcaagcgcggcgagaccgaccaccacgccgtgagccgggggtccgccaagctgcgctggttcgtggagcggaacatggtcacgcccgagggcaaggtggtggacctgggctgcgggcgcggcgggtggagctactactgcggcgggctcaagaacgtccgggaggtgaagggcctgaccaagggcgggcccggccacgaggagcccatcccgatgtccacctacgggtggaacctggtgcgcctccagagcggcgtcgacgtgttcttcacgccgcccgagaagtgcgacacgctgctgtgcgacatcggggagtccagccccaacccgaccgtggaggcgggccggaccctccgcgtcctgaacctggtggagaactggctcaacaacaacacccagttctgcatcaaggtgctgaacccctacatgccctccgtcatcgagaagatggaggccctgcagcggcgctacggcggggccctcgtgcggaacccgctgagccgcaacagcacccacgagatgtactgggtgtccaacgccagcggcaacatcgtctccagcgtgaacatgatctcccggatgctgatcaaccgcttcacgatgaagcacaagaaggccacctacgagcccgacgtggacctggggagcggcacccggaacatcgggatcgagtccgaggtccccaacctcgacatcatcggcaagcgcatcgagaagatcaagcaggagcacgagaccagctggcactacgaccaggaccacccctacaagacgtgggcgtaccacggctcctacgagaccaagcagaccgggagcgcctccagcatggtgaacggcgtggtccggctgctgaccaagccgtgggacgtgctccccacggtgacccagatggccatgaccgacaccacgcccttcgggcagcagcgcgtcttcaaggagaaggtggacacccgcacccaggagcccaaggagggcaccaagaagctgatgaagatcacggccgagtggctgtggaaggagctcggcaagaagaagaccccgcggatgtgcacccgcgaggagttcacccggaaggtccgctccaacgccgcgctgggggccatcttcacggacgagaacaagtggaagtccgcccgggaggccgtggaggactcccgcttctgggagctggtggacaaggagcggaacctccacctggagggcaagtgcgagacctgcgtctacaacatgatggggaagcgcgagaagaagctgggcgagttcgggaaggccaagggcagccgggcgatctggtacatgtggctcggcgcccgcttcctggagttcgagaccctggggttcctcaacgaggaccactggttctcccgggagaacagcctgtccggcgtggagggggagggcctgcacaagctcgggtacatcctgcgcgacgtgagcaagaaggagggcggcgccatgtacgccgacgacaccgcggggtgggacacgcggatcaccctggaggacctcaagaacgaggagatggtcaccaaccacatggagggcgagcacaagaagctggccgaggccatcttcaagctgacctaccagaacaaggtggtgcgcgtccagcggcccacgccccgcgggaccgtgatggacatcatcagccggcgcgaccagcggggctccggccaggtgggcacctacggcctcaacaccttcacgaacatggaggcccagctgatccgccagatggagggggagggcgtcttcaagaacatccagcacctgaccgccaccgaggagatcgcggtgcagaactggctcgcccgggtggggcgcgagcgcctgagccggatggccatctccggcgacgactgcgtcgtgaagcccctggacgaccgcttcgccagcgccctcaccgcgctgaacgacatgggcaagatccggaaggacatccagcagtgggagccgtcccgcgggtggaacgactggacccaggtgcccttctgcagccaccacttccacgagctgatcatgaaggacggccgggtcctcgtggtgccctgccgcaaccaggacgagctgatcgggcgggcccgcatctcccagggcgccgggtggagcctgcgggagaccgcctgcctcggcaagtcctacgcccagatgtggagcctgatgtacttccaccgccgggacctgcgcctcgcggccaacgccatctgctccgccgtccccagccactgggtgccgacctcccggaccacctggagcatccacgccaagcacgagtggatgacgaccgaggacatgctggcggtgtggaaccgcgtctggatccaggagaacccctggatggaggacaagacccccgtggagtcctgggaggagatcccctacctgggcaagcgggaggaccagtggtgcgggagcctcatcggcctgacctcccgcgccacgtgggccaagaacatccaggccgcgatcaaccaggtgcggagcctgatcgggaacgaggagtacaccgactacatgccgagcatgaagcgcttccggcgcgaggaggaggaggccggcgtcctctggtga

SEQ ID NO: 9810 - RNA, 9876 nt, synthetic construct
  misc_feature 1..9876: note = derived and/or modified CDS sequence (opt1) from DENV-2__AF169687__SS-prME
  source 1..9876: mol_type = other RNA
agcgcgggcatgatcatcatgctgatccccaccgtgatggccttccacctcaccacccgcaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaactccaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcacccggggttcaccatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgccgcatccccttcgagatcatggacctggagaagcggtacgtgctcggccgcctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccgctccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccggagcgtgacccgcctggagaacctcatgtggaagcagatcacccccgagctgaaccacatcctgtccgagaacgaggtcaagctcaccatcatgacgggggacatcaagggcatcatgcacgccgggaagcggagcctgcgcccgcagcccaccgagctgaagtactcctggaagacctggggcatcgccaagatgctcagcaccgagtcccacaaccagacgttcctgatcgacggccccgagaccgcggagtgcccgaacaccaaccgggcctggaacagcctggaggtggaggactacgggttcggcgtgttcaccacgaacatctggctcaagctgaaggagaagcaggacgccttctgcgactccaagctgatgagcgccgccatcaaggacaaccgcgcggtccacgccgacatggggtactggatcgagtccgccctcaacgacacctggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccggccggggtaccacacccagatcgcgggcccctggcacctggggaagctggagatggacttcgacttctgcgacggcaccacggtggtggtcaccgaggactgcgggaaccgcggccccagcctccggaccaccacggcctccggcaagctgatcaccgagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacgcgggtggggaccaagcacgcgatcctcctggtcgccgtgtccttcgtgaccctgatcaccggcaacatgagcttcaaggacctcgggcgcgtcgtggtgacggtcggcgccaccatgaccgacgacatcgggatgggcgtgacctacctggccctgctcgccgcgttcaaggtgcggcccacgttcgccgccggcctgctgctccgcaagctgacctccaaggagctgatgatgaccaccatcgggatcgtcctcctgagccagtccacgatccccgagaccatcctggagctcaccgacgccctggccctgggcatgatggtgctcaagatcgtgcgcaacatggagaagtaccagctggcggtcaccatcatggccatcctgtgcgtgccgaacgccgtcatcctccagaacgcctggaaggtgagctgcacgatcctggccgtggtctccgtgagccccctgatcctcacctccagccagcagaagaccgactggatccccctggcgctgaccatcaaggggctcaaccccacggccatcttcctgaccaccctgtcccggaccaacaagaagcgcagctggccgctcaacgaggccatcatggccgtgggcatggtctccatcctggcgagctccctgctcaagaacgacatccccatgacgggccccctggtggccgggggcctgctcaccgtgtgctacgtcctgaccgggcggagcgccgacctggagctcgagcgcgccaccgacgtgaagtgggaggaccaggccgagatcagcggctccagccccatcctgtccatcacgatcagcgaggacgggtccatgagcatcaagaacgaggaggaggagcagaccctgaccatcctcatccggaccggcctgctggtgatctccggcctcttcccggtcagcatccccatcaccgcggccgcctggtacctgtgggaggtgaagaagcagcgcgccggggtgctgtgggacgtccccagcccgccgcccatgggcaaggccgagctcgaggacggggcgtaccggatcaagcagaagggcatcctggggtacagccagatcggcgccggcgtgtacaaggaggggacgttccacaccatgtggcacgtgacccgcggcgccgtcctgatgcacaaggggaagcggatcgagccctcctgggccgacgtgaagaaggacctcatcagctacggcgggggctggaagctggagggcgagtggaaggagggggaggaggtgcaggtcctggccctcgagcccggcaagaacccccgcgcggtgcagaccaagcccgggctgttcaagacgaacaccggcaccatcggggccgtgtccctggacttcagccccggcacctccggcagccccatcatcgacaagaaggggaaggtcgtgggcctctacgggaacggcgtggtcacgcggtccggcgcctacgtgagcgccatcgcccagaccgagaagtccatcgaggacaaccccgagatcgaggacgacatcttccgcaagcggcgcctgaccatcatggacctgcaccccggggcgggcaagaccaagcggtacctgcccgccatcgtgcgcgaggccatcaagcgggggctccgcacgctgatcctggccccgacccgggtcgtggcggccgagatggaggaggccctccgcggcctgcccatccggtaccagacccccgccatccgcgccgagcacaccgggcgcgagatcgtggacctgatgtgccacgcgacgttcaccatgcggctcctgagccccgtccgcgtgccgaactacaacctgatcatcatggacgaggcccacttcaccgaccccgccagcatcgccgcccggggctacatctccacccgcgtggagatgggcgaggcggccgggatcttcatgacggccacgccgcccggcagccgggacccgttcccccagtccaacgcccccatcatcgacgaggagcgcgagatccccgagcggagctggaactccgggcacgagtgggtcaccgacttcaagggcaagaccgtgtggttcgtgccgagcatcaaggccgggaacgacatcgcggcctgcctccgcaagaacggcaagaaggtcatccagctgtcccggaagacgttcgacagcgagtacgtgaagacccgcaccaacgactgggacttcgtggtcaccacggacatctccgagatgggcgccaacttcaaggccgagcgggtgatcgacccccgccggtgcatgaagcccgtgatcctgaccgacggggaggagcgcgtcatcctcgcgggccccatgccggtgacccacttcagcgccgcccagcggcgcgggcggatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccggaagacgttcgtcgacctgatgcgccggggcgacctccccgtgtggctggcctacaaggtggccgccgaggggatcaactacgcggaccgccggtggtgcttcgacggcatcaagaacaaccagatcctggaggagaacgtcgaggtggagatctggaccaaggagggggagcgcaagaagctcaagccgcggtggctggacgcccgcatctacagcgaccccctggccctcaaggagttcaaggagttcgccgccggccggaagtccctggcgctgaacctcatcaccgagatgggccgcctgcccaccttcatgacgcagaagacccgggacgccctggacaacctcgccgtcctgcacaccgccgaggccgggggccgcgcctacaaccacgccctgagcgagctccccgagaccctggagacgctgctcctgctgaccctcctggccaccgtgaccgggggcatcttcctgttcctcatgtccggccgggggatcggcaagatgaccctggggatgtgctgcatcatcacggccagcatcctgctctggtacgcgcagatccagccgcactggatcgccgcctccatcatcctggtgttcttcctgatcgtcctcctgatccccgagcccgagaagcagcgcacgccccaggacaaccagctgacctacgtggtgatcgccatcctcaccgtcgtggccgcgacgatggccaacgagatgggcttcctggagaagaccaagaaggacctggggttcggcagcatcgccacccagcagccggagtccaacatcctcgacatcgacctgcggcccgccagcgcctggaccctgtacgcggtggccacgaccttcgtcacccccatgctccgccacagcatcgagaactccagcgtgaacgtgtccctgaccgccatcgccaaccaggccacggtcctgatgggcctcgggaagggctggcccctgagcaagatggacatcggggtgccgctgctcgcgatcggctgctactcccaggtgaaccccatcaccctgaccgccgccctgctcctgctggtcgcccactacgcgatcatcgggcccggcctccaggccaaggccacccgggaggcccagaagcgcgccgcggccggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgccaccgggcccatcagcaccctgtgggagggcaacccggggcgcttctggaacacgaccatcgcggtgtccatggccaacatcttccggggcagctacctggccggcgccgggctcctgttctccatcatgaagaacaccaccaacacgcgccgcggcaccgggaacatcggcgagaccctgggcgagaagtggaagtcccggctcaacgccctggggaagtccgagttccagatctacaagaagtccggcatccaggaggtggaccgcaccctggcgaaggaggggatcaagcggggcgagacggaccaccacgccgtctcccgcgggagcgccaagctccggtggttcgtggagcgcaacatggtgacccccgagggcaaggtcgtggacctgggctccgggcggggcgggtggagctactactgcggcgggctgaagaacgtgcgcgaggtcaagggcctcaccaagggcgggcccggccacgaggagcccatcccgatgtccacctacgggtggaacctggtgcggctgcagagcggcgtggacgtcttcttcatcccgcccgagaagtgcgacacgctcctgtgcgacatcggggagtccagccccaacccgaccgtggaggccggccgcaccctgcgggtgctcaacctggtcgagaactggctgaacaacaacacccagttctgcatcaaggtgctcaacccctacatgcccagcgtgatcgagaagatggaggcgctgcagcgcaagtacggcggggccctggtccggaacccgctgtcccgcaacagcacccacgagatgtactgggtgtccaacgccagcggcaacatcgtgtccagcgtcaacatgatctcccggatgctcatcaaccgcttcacgatgcggcacaagaaggccacctacgagcccgacgtggacctggggagcggcacccgcaacatcgggatcgagtccgagatccccaacctggacatcatcggcaagcggatcgagaagatcaagcaggagcacgagaccagctggcactacgaccaggaccacccctacaagacgtgggcctaccacggctcctacgagaccaagcagaccgggagcgcgtccagcatggtgaacggcgtcgtgcgcctcctgaccaagccgtgggacgtgctgcccacggtcacccagatggccatgaccgacaccacgcccttcgggcagcagcgcgtgttcaaggagaaggtggacacccggacccaggagcccaaggagggcaccaagaagctcatgaagatcacggccgagtggctgtggaaggagctgggcaagaagaagaccccgcgcatgtgcacccgggaggagttcacccgcaaggtccggtccaacgccgccctcggggcgatcttcacggacgagaacaagtggaagtccgcccgcgaggccgtggaggactcccggttctgggagctggtcgacaaggagcgcaacctgcacctcgagggcaagtgcgagacctgcgtgtacaacatgatggggaagcgggagaagaagctgggcgagttcgggaaggccaagggcagccgcgccatctggtacatgtggctgggcgcgcggttcctcgagttcgaggccctggggttcctgaacgaggaccactggttctcccgcgagaacagcctcagcggcgtggagggggagggctcccacaagctggggtacatcctgcgggacgtcagcaagaaggagggcggcgccatgtacgccgacgacaccgcggggtgggacacccgcatcacgctcgaggacctgaagaacgaggagatggtgaccaaccacatggagggcgagcacaagaagctggccgaggccatcttcaagctcacctaccagaacaaggtggtccgggtgcagcgccccacgccccgggggacggtgatggacatcatctcccgccgggaccagcgcggcagcgggcaggtcggcacctacggcctgaacaccttcaccaacatggaggcccagctgatccggcagatggagggggagggcgtgttcaagaacatccagcacctcacggccaccgaggagatcgcggtgcagaactggctggcccgcgtcgggcgcgagcggctgtcccgcatggccatcagcggcgacgactgcgtggtgaagcccctcgacgaccggttcgcctccgccctgaccgcgctgaacgacatgggcaagatccgcaaggacatccagcagtgggagccgagccgggggtggaacgactggacccaggtccccttctgctcccaccacttccacgagctcatcatgaaggacggccgcgtgctggtggtcccctgccggaaccaggacgagctgatcgggcgcgcccggatcagccagggcgccgggtggtccctccgcgagacggcctgcctgggcaagagctacgcccagatgtggtccctgatgtacttccaccggcgcgacctccggctggcggccaacgccatctgcagcgccgtgccctcccactgggtgccgaccagccgcaccacctggtccatccacgccaagcacgagtggatgaccacggaggacatgctgaccgtctggaaccgggtgtggatccaggagaacccctggatggaggacaagacccccgtggagagctgggaggagatcccctacctcggcaagcgcgaggaccagtggtgcgggagcctgatcggcctgacctcccgggcgacgtgggccaagaacatccaggccgccatcaaccaggtccgcagcctcatcgggaacgaggagtacaccgactacatgccgtccatgaagcggttccgccgcgaggaggaggaggcgggcgtgctgtggtga

SEQ ID NO: 9811 - RNA, 9876 nt, synthetic construct
  misc_feature 1..9876: note = derived and/or modified CDS sequence (opt1) from DENV-2__AF169688__SS-prME
  source 1..9876: mol_type = other RNA
agcgcgggcatgatcatcatgctgatccccaccgtgatggccttccacctcaccacccggaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaactccaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcacccggggttcaccatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagacgtccagcgggaacctcctgttcaccggccacctgaagtgccggctgcgcatggacaagctccagctgaagggcatgtcctacagcatgtgcaccgggaagttcaaggtggtgaaggagatcgccgagacccagcacggcacgatcgtcatccgggtgcagtacgagggggacggctccccctgccgcatccccttcgagatcatggacctggagaagcggtacgtgctcggccgcctgatcaccgtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccacgatgcgcggcgccaagcggatggccatcctgggcgacaccgcctgggacttcgggagcctgggcggggtgttcacctccatcggcaaggccctccaccaggtgttcggggcgatctacggcgccgccttcagcggcgtctcctggaccatgaagatcctgatcggggtgatcatcacgtggatcggcatgaacagccgctccaccagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacgtggaccgagcagtacaagttccagcccgagtcccccagcaagctggcgtccgccatccagaaggcccaggaggaggggatctgcggcatccggagcgtgacccgcctggagaacctcatgtggaagcagatcacccccgagctgaaccacatcctggccgagaacgaggtcaagctcacgatcatgaccggggacatcaagggcatcatgcacgccgggaagcggtccctgcgcccgcagcccaccgagctgaagtacagctggaagacctggggcaaggcgaagatgctctccacggagagccacaaccagaccttcctgatcgacggccccgagaccgccgagtgcccgaacaccaaccgggcctggaactccctggaggtggaggactacgggttcggcgtgttcacgaccaacatctggctcaagctgaaggagaagcaggacgccttctgcgacagcaagctgatgtccgccgcgatcaaggacaaccgcgccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccggccggggtaccacacccagatcgccggcccctggcacctggggaagctggagatggacttcgacttctgcgacggcacgaccgtggtggtcaccgaggactgcgggaaccgcggccccagcctccggaccacgaccgccagcggcaagctgatcaccgagtggtgctgccgctcctgcaccctgcccccgctccggtaccgcggggaggacggctgctggtacgggatggagatccggcccctgaaggagaaggaggagaacctggtgaacagcctcgtgacggccggccacgggcaggtcgacaacttctccctgggcgtgctgggcatggccctcttcctggaggagatgctgcgcacccgggtggggaccaagcacgccatcctcctggtcgccgtgagcttcgtgaccctgatcacgggcaacatgtccttcaaggacctcgggcgcgtcgtggtgatggtcggcgccaccatgaccgacgacatcgggatgggcgtgacctacctggccctgctcgcggccttcaaggtgcggcccacgttcgccgccggcctgctgctccgcaagctgaccagcaaggagctgatgatgaccaccatcgggatcgtcctcctgtcccagagcacgatccccgagaccatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcacgatcctggcggtggtcagcgtgagccccctgatcctcaccagctcccagcagaagaccgactggatccccctggccctgaccatcaaggggctcaaccccacggccatcttcctgaccaccctgagccggaccaacaagaagcgctcctggccgctcaacgaggccatcatggcggtgggcatggtcagcatcctggcctccagcctgctcaagaacgacatccccatgacgggccccctggtggccgggggcctgctcaccgtgtgctacgtcctgaccgggcggtccgccgacctggagctcgagcgcgccaccgacgtgaagtgggaggaccaggcggagatcagcggcagctcccccatcctgagcatcacgatctccgaggacgggagcatgtccatcaagaacgaggaggaggagcagaccctgaccatcctcatccggaccggcctgctggtgatcagcggcctcttcccggtctccatccccatcaccgccgccgcctggtacctgtgggaggtgaagaagcagcgcgccggggtgctgtgggacgtcccctccccgccgcccatgggcaaggcggagctcgaggacggggcctaccggatcaagcagaagggcatcctggggtactcccagatcggcgccggcgtgtacaaggaggggacgttccacaccatgtggcacgtgacccgcggcgccgtcctgatgcacaaggggaagcggatcgagcccagctgggccgacgtgaagaaggacctcatctcctacggcgggggctggaagctggagggcgagtggaaggagggggaggaggtgcaggtcctggcgctcgagcccggcaagaacccccgcgccgtgcagaccaagcccgggctgttcaagacgaacaccggcaccatcggggccgtgagcctggacttctcccccggcaccagcggctcccccatcatcgacaagaaggggaaggtcgtgggcctctacgggaacggcgtggtcacgcggagcggcgcctacgtgtccgccatcgcgcagaccgagaagtccatcgaggacaaccccgagatcgaggacgacatcttccgcaagcggcgcctgaccatcatggacctgcaccccggggccggcaagaccaagcggtacctgcccgccatcgtgcgcgaggccatcaagcgggggctccgcacgctgatcctggcgccgacccgggtcgtggccgccgagatggaggaggccctccgcggcctgcccatccggtaccagacccccgccatccgcgcggagcacaccgggcgcgagatcgtggacctgatgtgccacgccacgttcaccatgcggctcctgtcccccgtccgcgtgccgaactacaacctgatcatcatggacgaggcccacttcaccgaccccgccagcatcgccgcgcggggctacatcagcacccgcgtggagatgggcgaggccgccgggatcttcatgacggccacgccgcccggctcccgggacccgttcccccagagcaacgcccccatcatcgacgaggagcgcgagatccccgagcggtcctggaacagcgggcacgagtgggtcaccgacttcaagggcaagaccgtgtggttcgtgccgtccatcaaggcggggaacgacatcgccgcctgcctccgcaagaacggcaagaaggtcatccagctgagccggaagacgttcgactccgagtacgtgaagacccgcaccaacgactgggacttcgtggtcaccacggacatcagcgagatgggcgccaacttcaaggcggagcgggtgatcgacccccgccggtgcatgaagcccgtgatcctgaccgacggggaggagcgcgtcatcctcgccggccccatgccggtgacccacttctccgccgcccagcggcgcgggcggatcggccgcaaccccaagaacgagaacgaccagtacatctacatgggggagcccctggagaacgacgaggactgcgcccactggaaggaggcgaagatgctgctcgacaacatcaacacccccgagggcatcatcccgagcatgttcgagcccgagcgggagaaggtggacgccatcgacggcgagtaccgcctgcgcggggaggcccggaagacgttcgtcgacctgatgcgccggggcgacctccccgtgtggctggcctacaaggtggccgcggaggggatcaactacgccgaccgccggtggtgcttcgacggcatcaagaacaaccagatcctggaggagaacgtcgaggtggagatctggaccaaggagggggagcgcaagaagctcaagccgcggtggctggacgcccgcatctactccgaccccctggccctcaaggagttcaaggagttcgccgcgggccgcaagagcctggccctgaacctcatcaccgagatgggccgcctgcccaccttcatgacgcagaagacccgggacgccctggacaacctcgccgtcctgcacaccgcggaggccgggggccgcgcctacaaccacgccctgtccgagctccccgagaccctggagacgctgctcctgctgaccctcctggccaccgtgaccgggggcatcttcctgttcctcatgagcggccgggggatcggcaagatgaccctggggatgtgctgcatcatcacggcgtccatcctgctctggtacgcccagatccagccgcactggatcgccgccagcatcatcctggtgttcttcctgatcgtcctcctgatccccgagcccgagaagcagcgcacgccccaggacaaccagctgacctacgtggtgatcgccatcctcaccgtcgtggcggccacgatggccaacgagatgggcttcctggagaagaccaagaaggacctggggttcggctccatcgccacccagcagccggagagcaacatcctcgacatcgacctgcggcccgcctccgcgtggaccctgtacgccgtggccacgaccttcgtcacccccatgctccgccacagcatcgagaacagctccgtgaacgtgagcctgaccgccatcgccaaccaggcgacggtcctgatgggcctcgggaagggctggcccctgtccaagatggacatcggggtgccgctgctcgccatcggctgctacagccaggtgaaccccatcaccctgaccgccgccctgctcctgctggtcgcgcactacgccatcatcgggcccggcctccaggccaaggccacccgggaggcccagaagcgcgcggccgccggcatcatgaagaaccccacggtggacgggatcaccgtgatcgacctggacccgatcccctacgaccccaagttcgagaagcagctgggccaggtcatgctcctggtgctgtgcgtgacccaggtcctcatgatgcggaccacgtgggccctgtgcgaggccctgaccctcgcgaccgggcccatctccaccctgtgggagggcaacccggggcgcttctggaacacgaccatcgccgtgagcatggccaacatcttccggggctcctacctggccggcgccgggctcctgttcagcatcatgaagaacaccaccaacacgcgccgcggcaccgggaacatcggcaagaccctgggcgagaagtggaagtcccggctcaacgcgctggggaagatcgagttccagatctacaagaagtccggcatccaggaggtggaccgcaccctggccaaggaggggatcaagcggggcgagacggaccaccacgccgtctcccgcgggagcgccaagctccggtggttcgtggagcgcaacatggtgacccccgagggcaaggtcgtggacctgggctgcgggcggggcgggtggtcctactactgcggcgggctgaagaacgtgcgcgaggtcaagggcctcaccaagggcgggcccggccacgaggagcccatcccgatgagcacctacgggtggaacctggtgcggctgcagtccggcgtggacgtcttcttcatcccgcccgagaagtgcgacacgctcctgtgcgacatcggggagagctcccccaacccgaccgtggaggcgggccgcaccctgcgggtgctcaacctggtcgagaactggctgaacaacaacacccagttctgcatcaaggtgctcaacccctacatgcccagcgtgatcgagaagatggaggccctgcagcgcaagtacggcggggccctggtccggaacccgctgtcccgcaacagcacccacgagatgtactgggtgagcaacgcctccggcaacatcgtgagctccgtcaacatgatcagccggatgctcatcaaccgcttcacgatgcggcacaagaaggccacctacgagcccgacgtggacctggggtccggcacccgcaacatcgggatcgagagcgagatccccaacctggacatcatcggcaagcggatcgagaagatcaagcaggagcacgagacctcctggcactacgaccaggaccacccctacaagacgtgggcgtaccacggcagctacgagaccaagcagaccgggtccgccagctccatggtgaacggcgtcgtgcgcctcctgaccaagccgtgggacgtgctgcccacggtcacccagatggccatgaccgacaccacgcccttcgggcagcagcgcgtgttcaaggagaaggtggacacccggacccaggagcccaaggagggcaccaagaagctcatgaagatcacggccgagtggctgtggaaggagctgggcaagaagaagaccccgcgcatgtgcacccgggaggagttcacccgcaaggtccggagcaacgccgcgctcggggccatcttcacggacgagaacaagtggaagtccgcccgcgaggccgtggaggacagccggttctgggagctggtcgacaaggagcgcaacctgcacctcgagggcaagtgcgagacctgcgtgtacaacatgatggggaagcgggagaagaagctgggcgagttcgggaaggccaagggctcccgcgcgatctggtacatgtggctgggcgcccggttcctcgagttcgaggccctggggttcctgaacgaggaccactggttcagccgcgagaactccctcagcggcgtggagggggagggcctgcacaagctggggtacatcctccgggacgtctccaagaaggagggcggcgccatgtacgcggacgacaccgccgggtgggacacccgcatcacgctggaggacctgaagaacgaggagatggtgaccaaccacatggagggcgagcacaagaagctcgccgaggccatcttcaagctgacctaccagaacaaggtggtccgggtgcagcgccccacgccccgggggacggtgatggacatcatcagccgccgggaccagcgcggcagcgggcaggtcggcacctacggcctgaacaccttcaccaacatggaggcccagctcatccggcagatggagggggagggcgtgttcaagaacatccagcacctgacggcgaccgaggagatcgccgtgcagaactggctggcccgcgtcgggcgcgagcggctctcccgcatggccatcagcggcgacgactgcgtggtgaagcccctggacgaccggttcgcctccgcgctgaccgccctcaacgacatgggcaagatccgcaaggacatccagcagtgggagccgagccgggggtggaacgactggacccaggtccccttctgctcccaccacttccacgagctgatcatgaaggacggccgcgtgctggtggtcccctgccggaaccaggacgagctcatcgggcgcgcccggatcagccagggcgccgggtggtccctgcgcgagacggcctgcctgggcaagagctacgcgcagatgtggtccctcatgtacttccaccggcgcgacctgcggctggccgccaacgccatctgcagcgccgtgccctcccactgggtgccgaccagccgcaccacctggtccatccacgcgaagcacgagtggatgaccacggaggacatgctcaccgtctggaaccgggtgtggatccaggagaacccctggatggaggacaagacccccgtggagagctgggaggagatcccctacctgggcaagcgcgaggaccagtggtgcgggtccctgatcggcctcaccagccgggccacgtgggccaagaacatccaggccgcgatcaaccaggtccgctccctgatcgggaacgaggagtacaccgactacatgccgagcatgaagcggttccgccgcgaggaggaggaggccggcgtgctgtggtga

SEQ ID NO: 9812 - RNA, 9873 nt, synthetic construct
  misc_feature 1..9873: note = derived and/or modified CDS sequence (opt1) from DENV-3__AB189125__SS-prME
  source 1..9873: mol_type = other RNA
acctccctgtgcctcatgatgatgctgcccgccaccctggccttccacctcacctcccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggcggacatggggtgcgtcatcaactggaagggcaaggagctcaagtgcggctccgggatcttcgtgaccaacgaggtgcacacctggacggagcagtacaagttccaggccgacagccccaagcggctggccaccgccatcgccggcgcgtgggagaacggggtctgcggcatccgctccaccacccgcatggagaacctgctctggaagcagatcgccaacgagctgaactacatcctgtgggagaacaacatcaagctcacggtggtggtcggggacatcatcggcatcctggagcagggcaagcggaccctgacgccccagcccatggagctcaagtacagctggaagacctgggggaaggccaagatcgtgacggccgagatccagaactccagcttcatcatcgacggcccgaacacccccgagtgccccaacgcgtcccgcgcctggaacgtgtgggaggtcgaggactacgggttcggcgtgttcaccaccaacatctggctgaagctgcgggagatgtacacgcagctctgcgaccaccgcctgatgagcgccgccgtgaaggacgagcgggccgtccacgcggacatgggctactggatcgagagccagaagaacgggtcctggaagctggagaaggccagcctcatcgaggtgaagacctgcacctggcccaagtcccacaccctgtggagcaacggcgtgctggagtccgacatgatcatccccaagtccctcgccgggcccatctcccagcacaactaccgccccggctaccacacccagacggccgggccgtggcacctgggcaagctggagctcgacttcaactactgcgagggcaccaccgtcgtgatcaccgagaactgcgggacgcggggccccagcctgcgcaccaccaccgtgtccgggaagctgatccacgagtggtgctgccggagctgcacgctgccgcccctccgctacatgggcgaggacgggtgctggtacggcatggagatccggccgatcaacgagaaggaggagaacatggtcaagtccctggtgagcgccggctccgggaaggtggacaacttcaccatgggcgtcctctgcctggcgatcctgttcgaggaggtgatgcgcgggaagttcggcaagaagcacatgatcgccggggtcctgttcaccttcgtcctgctgctcagcggccagatcacctggcgggacatggcccgcacgctgatcatgatcggctccaacgccagcgaccggatggggatgggcgtgacctacctggccctcatcgcgaccttcaagatccagcccttcctggccctggggttcttcctccgcaagctgacctcccgggagaacctgctcctgggcgtgggcctggccatggccacgaccctccagctgcccgaggacatcgagcagatggcgaacgggatcgccctgggcctcatggccctgaagctgatcacccagttcgagacctaccagctctggacggccctggtcagcctgatgtgcagcaacaccatcttcaccctcaccgtggcctggcgcacggcgaccctgatcctggccgggatctccctcctgcccgtgtgccagagctccagcatgcggaagaccgactggctgccgatgaccgtcgccgccatgggcgtgccgcccctccccctgttcatcttctccctgaaggacacgctcaagcgccgcagctggccgctgaacgagggggtcatggccgtgggcctggtgtccatcctcgcgagctccctgctgcggaacgacgtccccatggccggccccctcgtggccgggggcctgctgatcgcctgctacgtgatcaccgggaccagcgccgacctcaccgtcgagaaggcggccgacgtgacgtgggaggaggaggccgagcagaccggcgtgtcccacaacctgatgatcaccgtcgacgacgacgggaccatgcgcatcaaggacgacgagacggagaacatcctgaccgtgctcctgaagaccgccctgctcatcgtgagcggcatcttcccctactccatcccggccaccctgctggtctggcacacctggcagaagcagacgcagcggagcggcgtgctctgggacgtgcccagcccgcccgagacccagaaggcggagctggaggagggggtctaccgcatcaagcagcagggcatcttcgggaagacccaggtgggcgtgggggtccagaaggagggcgtgttccacaccatgtggcacgtgacgcggggcgccgtcctgacctacaacgggaagcgcctcgagccgagctgggcctccgtgaagaaggacctgatcagctacggcgggggctggcggctgtccgcccagtggcagaagggggaggaggtgcaggtcatcgcggtggagcccggcaagaaccccaagaacttccagaccatgcccggcatcttccagaccacgaccggggagatcggcgccatcgccctggacttcaagccggggaccagcggcagccccatcatcaaccgcgagggcaaggtggtcgggctctacggcaacggggtggtgaccaagaacggcgggtacgtctccggcatcgcccagacgaacgccgagcccgacggcccgacccccgagctggaggaggagatgttcaagaagcggaacctgaccatcatggacctccaccccgggagcggcaagacccgcaagtacctgcccgcgatcgtgcgggaggccatcaagcgccggctgcgcacgctcatcctggccccgacccgggtggtcgccgccgagatggaggaggcgctgaaggggctccccatccgctaccagaccaccgccacgaagtccgagcacaccggcaaggagatcgtggacctgatgtgccacgccaccttcaccatgcggctgctcagccccgtgcgcgtccccaactacaacctgatcatcatggacgaggcccacttcacggacccggcctccatcgcggcccgggggtacatcagcacccgcgtgggcatgggcgaggccgccgcgatcttcatgaccgccacgccgcccgggacggccgacgccttcccccagtccaacgccccgatccaggacgaggagcgggacatccccgagcgcagctggaactccggcaacgactggatcaccgacttcgcggggaagaccgtgtggttcgtccccagcatcaaggccggcaacgacatcgccaactgcctgcgcaagaacgggaagaaggtgatccagctctcccggaagaccttcgacacggagtaccagaagaccaagctgaacgactgggacttcgtggtcaccaccgacatcagcgagatgggcgccaacttcaaggccgaccgcgtgatcgacccccggcgctgcctgaagccggtgatcctcacggacggccccgagcgggtcatcctggcggggcccatgcccgtgaccgtggcctccgccgcccagcgccggggccgcgtcgggcggaacccgcagaaggagaacgaccagtacatcttcaccggccagcccctgaacaacgacgaggaccacgcccactggaccgaggcgaagatgctcctggacaacatcaacacgcccgaggggatcatccccgccctgttcgagccggagcgcgagaagtccgccgccatcgacggcgagtaccggctcaagggcgagagccgcaagaccttcgtggagctgatgcggcgcggggacctgcccgtgtggctcgcgcacaaggtcgccagcgagggcatcaagtacaccgaccggaagtggtgcttcgacggggagcgcaacaaccagatcctggaggagaacgtggacgtcgagatctggaccaaggagggcgagaagaagaagctgcggccccgctggctcgacgcccggacctactccgaccccctggccctgaaggagttcaaggacttcgccgcgggccgcaagagcatcgccctcgacctggtgacggagatcgggcgcgtgccgtcccacctggcccaccggacccgcaacgccctcgacaacctggtcatgctgcacaccagcgagcacggcgggcgggcctaccgccacgcggtggaggagctccccgagaccatggagacgctgctgctcctgggcctgatgatcctcctgaccgggggcgtgatgctgttcctcatcagcggcaagggggtcggcaagacctccatcgggctgatctgcgtggtggccagctccggcatgctgtggatggccgacatccccctccagtggatcgccagcgccatcgtcctggagttcttcatgatggtgctgctcatcccggagcccgagaagcagcggacgccccaggacaaccagctggcgtacgtggtcatcgggatcctgacgctcgccgccatcgtggccgccaacgagatgggcctgctggagaccaccaagcgcgacctcggcatgtccaaggagcccggggtggtcagcccgacctcctacctggacgtggacctgcaccccgcgagcgcctggacgctctacgccgtggccaccaccgtcatcacccccatgctgcggcacacgatcgagaactccaccgcgaacgtgagcctggccgccatcgccaaccaggccgtggtcctcatgggcctggacaaggggtggcccatctccaagatggacctgggcgtgccgctcctggcgctggggtgctacagccaggtgaaccccctcaccctgaccgccgccgtcctgctcctggtgacgcactacgccatcatcggccccggcctgcaggccaaggcgacccgcgaggcccagaagcggaccgccgccgggatcatgaagaaccccaccgtggacggcatcatgacgatcgacctcgacccggtcatctacgactccaagttcgagaagcagctgggccaggtgatgctgctcgtgctgtgcgccgtccagctgctcctgatgcgcaccagctgggcgttctgcgaggccctgaccctcgccaccggccccatcacgaccctgtgggagggctcccccgggaagttctggaacaccaccatcgccgtgagcatggcgaacatcttccggggctcctacctggccggggccggcctcgccttcagcatcatgaagtccgtggggacgggcaagcgcggcaccgggagccagggcgagaccctgggggagaagtggaagaagaagctgaaccagctcagccggaaggagttcgacctgtacaagaagtccggcatcaccgaggtcgaccgcacggaggccaaggaggggctgaagcggggcgagatcacccaccacgcggtgagccgcggctccgccaagctccagtggttcgtggagcggaacatggtcatccccgaggggcgcgtgatcgacctgggctgcgggcggggcgggtggagctactactgcgccggcctgaagaaggtgaccgaggtccgcggctacaccaagggcgggccggggcacgaggagcccgtgcccatgtccacctacggctggaacatcgtgaagctcatgagcgggaaggacgtcttctacctgcccccggagaagtgcgacacgctgctgtgcgacatcggcgagtccagcccctcccccaccgtggaggagagccggaccatccgcgtgctcaagatggtcgagccctggctgaagaacaaccagttctgcatcaaggtgctgaacccgtacatgcccgccgtgatcgagcacctcgagcgcctgcagcggaagcacggcgggatgctggtccgcaaccccctctcccggaacagcacccacgagatgtactggatctccaacggcacggggaacatcgtgagctccgtgaacatggtcagccgcctgctgctcaaccggttcaccatgacctaccgccggcccaccatcgagaaggacgtggacctgggcgccggcacgcgccacgtcaacgcggagccggagacccccaacatggacgtgatcggggagcggatccgccggatcaaggaggagcactccagcacctggcactacgacgacgagaacccctacaagacctgggcctaccacggctcctacgaggtgaaggccacggggagcgccagctccatgatcaacggcgtcgtgaagctgctcaccaagccgtgggacgtggtccccaccgtgacccagatggccatgacggacaccacccccttcgggcagcagcgcgtgttcaaggagaaggtcgacacccggacgcccaagccgatgcccggcacccgcaaggtgatggagatcaccgcggagtggctgtggcggaccctgggccgcaacaagcggccccgcctctgcacgcgggaggagttcaccaagaaggtgcgcaccaacgccgccatgggggccgtcttcaccgaggagaaccagtgggacagcgcgcgcgccgccgtggaggacgaggagttctggaagctggtggaccgggagcgcgagctgcacaagctcggcaagtgcgggtcctgcgtctacaacatgatgggcaagcgggagaagaagctgggggagttcggcaaggccaagggcagccgcgccatctggtacatgtggctgggggcgcggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgccgacgacacggccggctgggacacccgcatcaccgaggacgacctccacaacgaggagaagatcacccagcagatggacccggagcaccggcagctggcgaacgccatcttcaagctgacgtaccagaacaaggtggtcaaggtgcagcgccccacccccaaggggaccgtgatggacatcatctcccggaaggaccagcgcggcagcggccaggtcgggacctacggcctcaacacgttcaccaacatggaggcccagctgatccggcagatggagggggagggcgtgctgtccaagaccgacctcgagaacccccacctcctggagaagaagatcacccagtggctcgagaccaagggggtggagcgcctgaagcggatggccatcagcggcgacgactgcgtcgtgaagccgatcgacgaccgcttcgccaacgcgctgctcgccctgaacgacatgggcaaggtgcggaaggacatcccccagtggcagccctccaaggggtggcacgactggcagcaggtccccttctgcagccaccacttccacgagctgatcatgaaggacggccgcaagctcgtggtgccgtgccggtcccaggacgagctgatcgggcgcgcccggatcagccagggcgccgggtggtccctgaaggagacggcctgcctcggcaaggcgtacgcccagatgtgggccctgatgtacttccaccgccgcgacctgcggctcgccagcaacgcgatctgctccgccgtccccgtgcactgggtgcccaccagccgcaccacctggagcatccacgcccaccaccagtggatgacgaccgaggacatgctgaccgtctggaaccgggtgtggatcgaggacaacccctggatggaggacaagaccccggtgacgacctgggaggacgtcccctacctgggcaagcgcgaggaccagtggtgcgggtccctcatcggcctgaccagccgggccacctgggcccagaacatcctgacggcgatccagcaggtccgctccctcatcgggaacgaggagttcctggactacatgcccagcatgaagcggttccgcaaggaggaggagtccgagggcgccatctggtga

SEQ ID NO: 9813 - RNA, 9873 nt, synthetic construct
  misc_feature 1..9873: note = derived and/or modified CDS sequence (opt1) from DENV-3__AB189126__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcgcgcagacctggatgagcgccgagggcgcctggcggcaggtggagaaggtcgagacgtgggccttccgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgctccccccgcaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggcggacatggggtgcgtcatcaactggaagggcaaggagctcaagtgcggctccgggatcttcgtgaccaacgaggtgcacacctggacggagcagtacaagttccaggccgacagccccaagcggctggccaccgccatcgccggcgcgtgggagaacggggtctgcggcatccgctccaccacccgcatggagaacctgctctggaagcagatcgccaacgagctgaactacatcctgtgggagaacaacatcaagctcacggtggtggtcggggacatcatcggcgtgctggagcagggcaagcggaccctgaccccccagcccatggagctcaagtacagctggaagacctgggggaaggccaaggtggtcacggccgagatccagaactccagcttcatcatcgacggcccgaacacccccgagtgccccaacgcgtcccgcgcctggaacgtgtgggaggtggaggactacgggttcggcgtcttcaccaccaacatctggctgaagctgcgggagatgtacacgcagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacctgcacctggcccaagtcccacaccctgtggagcaacggcgtgctggagtccgacatgatcatcccgaagagcctcgccgggcccatctcccagcacaactaccgccccggctaccacacccagacggccgggccgtggcacctgggcaagctggagctcgacttcaactactgcgagggcaccaccgtggtcatcaccgagaactgcgggacgcggggccccagcctgcgcaccaccaccgtgtccgggaagctgatccacgagtggtgctgccggagctgcacgctcccccccctgcgctacatgggcgaggacgggtgctggtacggcatggagatccggccgatcaacgagaaggaggagaacatggtgaagtccctggtcagcgccggctccgggaaggtggacaacttcaccatgggcgtgctctgcctggcgatcctgttcgaggaggtcatgcgcgggaagttcggcaagaagcacatgatcgccgggatcctcttcatcttcgtgctgctgctcagcggccagatcacctggcgggacatggcccgcaccctgatcatgatcggctccaacgccagcgaccggatggggatgggcgtgacgtacctggccctcatcgcgaccttcaagatccagcccttcctggccctggggttcttcctccgcaagctgacctcccgggagaacctgctcctgggcgtcggcctggccatggccaccacgctccagctgcccgaggacatcgagcagatggcgaacgggatcgccctgggcctcatggccctgaagctgatcacccagttcgagacctaccagctctggaccgccctggtgagcctgacgtgcagcaacaccatcttcaccctcaccgtggcctggcgcacggcgaccctgatcctggccgggatctccctcctgcccgtctgccagagctccagcatgcggaagaccgactggctgccgatgaccgtggccgccatgggcgtcccccccctccccctgttcatcttctccctgaaggacacgctcaagcgccgcagctggccgctgaacgagggggtgatggccgtgggcctggtctccatcctcgcgagctccctgctgcggaacgacgtgcccatggccggccccctcgtggccgggggcctgctgatcgcctgctacgtcatcaccgggaccagcgccgacctcaccgtggagaaggcggccgacgtgacgtgggaggaggaggccgagcagaccggcgtctcccacaacctgatgatcaccgtggacgacgacgggaccatgcgcatcaaggacgacgagacggagaacatcctgaccgtgctcctgaagaccgccctgctcatcgtcagcggcatcttcccctactccatcccggccaccctgctggtgtggcacacctggcagaagcagacgcagcggagcggcgtgctctgggacgtcccctccccccccgagacccagaaggcggagctggaggagggggtgtaccgcatcaagcagcagggcatcttcgggaagacccaggtgggcgtcggggtgcagaaggagggcgtgttccacaccatgtggcacgtcacgcggggcgccgtgctgacctacaacgggaagcgcctcgagccgaactgggccagcgtgaagaaggacctgatctcctacggcgggggctggcggctgagcgcccagtggcagaagggggaggaggtccaggtgatcgcggtggagcccggcaagaaccccaagaacttccagaccatgcccggcatcttccagaccacgaccggggagatcggcgccatcgccctggacttcaagccggggacctccggcagccccatcatcaaccgcgagggcaaggtcgtggggctctacggcaacggggtggtcaccaagaacggcgggtacgtgagcggcatcgcccagacgaacgccgagcccgacggcccgacccccgagctggaggaggagatgttcaagaagcggaacctgaccatcatggacctccaccccgggtccggcaagacccgcaagtacctgcccgcgatcgtgcgggaggccatcaagcgccggctgcgcacgctcatcctggccccgacccgggtcgtggccgccgagatggaggaggcgctgaaggggctccccatccgctaccagaccaccgccacgaagagcgagcacaccggcaaggagatcgtggacctgatgtgccacgccaccttcaccatgcggctgctctcccccgtccgcgtgcccaactacaacctgatcatcatggacgaggcccacttcacggacccggccagcatcgcggcccgggggtacatctccacccgcgtgggcatgggcgaggccgccgcgatcttcatgaccgccaccccccccgggacggccgacgccttcccccagagcaacgccccgatccaggacgaggagcgggacatccccgagcgctcctggaacagcggcaacgactggatcaccgacttcgcggggaagaccgtctggttcgtgccctccatcaaggccggcaacgacatcgccaactgcctgcgcaagaacgggaagaaggtgatccagctcagccggaagaccttcgacacggagtaccagaagaccaagctgaacgactgggacttcgtcgtgaccaccgacatctccgagatgggcgccaacttcaaggccgaccgcgtgatcgacccccggcgctgcctgaagccggtcatcctcacggacggccccgagcgggtgatcctggcggggcccatgcccgtgaccgtcgccagcgccgcccagcgccggggccgcgtggggcggaacccgcagaaggagaacgaccagtacatcttcaccggccagcccctgaacaacgacgaggaccacgcccactggaccgaggcgaagatgctcctggacaacatcaacacgcccgaggggatcatccccgccctgttcgagccggagcgcgagaagtccgccgccatcgacggcgagtaccggctcaagggcgagagccgcaagaccttcgtggagctgatgcggcgcggggacctgcccgtctggctcgcgcacaaggtggcctccgagggcatcaagtacaccgaccggaagtggtgcttcgacggggagcgcaacaaccagatcctggaggagaacatggacgtcgagatctggaccaaggagggcgagaagaagaagctgcggccccgctggctcgacgcccggacctacagcgaccccctggccctgaaggagttcaaggacttcgccgcgggccgcaagtccatcgccctcgacctggtgacggagatcgggcgcgtgccgagccacctggcccaccggacccgcaacgccctcgacaacctggtcatgctgcacacctccgagcacggcgggcgggcctaccgccacgcggtggaggagctccccgagaccatggagacgctgctgctcctgggcctgatgatcctcctgaccgggggcgccatgctgttcctcatcagcggcaagggggtgggcaagaccagcatcgggctgatctgcgtcgtggcctccagcggcatgctgtggatggccgacatccccctccagtggatcgcctccgcgatcgtgctggagttcttcatgatggtcctgctcatcccggagcccgagaagcagcggaccccccaggacaaccagctggcctacgtggtgatcgggatcctgacgctcgccgccatcgtcgccgcgaacgagatgggcctgctggagaccaccaagcgcgacctcggcatgagcaaggagcccggggtggtgccgcccacctcctacctggacgtcgacctgcaccccgccagcgcctggacgctctacgccgtggcgaccaccgtgatcacccccatgctgcggcacacgatcgagaactccaccgccaacgtcagcctggccgccatcgccaaccaggcggtggtgctcatgggcctggacaaggggtggccgatctccaagatggacctgggcgtccccctcctggccctggggtgctacagccaggtgaaccccctcaccctgaccgccgccgtgctgctcctggtcacgcactacgccatcatcggccccggcctgcaggcgaaggccacccgcgaggcccagaagcggaccgccgccgggatcatgaagaacccgaccgtggacggcatcatgacgatcgacctcgaccccgtgatctacgactccaagttcgagaagcagctggggcaggtcatgctgctcgtgctgtgcgcggtgcagctgctcctgatgcgcaccagctgggccttctgcgaggccctgaccctcgccaccggccccatcacgaccctgtgggagggctcccccgggaagttctggaacaccaccatcgcggtcagcatggccaacatcttccggggctcctacctggccggggccggcctcgccttcagcatcatgaagtccgtggggacgggcaagcgcggcaccgggagccagggcgagaccctgggggagaagtggaagaagaagctgaaccagctctcccggaaggagttcgacctgtacaagaagagcggcatcaccgaggtggaccgcacggaggcgaaggaggggctgaagcggggcgagatcacccaccacgccgtcagccgcggctccgccaagctccagtggttcgtggagcggaacatggtgatcccggaggggcgcgtcatcgacctgggctgcgggcggggcgggtggagctactactgcgccggcctgaagaaggtgaccgaggtgcgcggctacaccaaggggggccccgggcacgaggagcccgtccccatgtccacctacggctggaacatcgtgaagctcatgagcgggaaggacgtgttctacctgccgcccgagaagtgcgacacgctgctgtgcgacatcggcgagtccagcccctcccccaccgtcgaggagagccggaccatccgcgtgctcaagatggtggagccgtggctgaagaacaaccagttctgcatcaaggtcctgaacccctacatgcccaccgtgatcgagcacctcgagcgcctgcagcggaagcacggcgggatgctggtgcgcaaccccctctcccggaacagcacgcacgagatgtactggatctccaacggcaccgggaacatcgtcagctccgtgaacatggtgagccgcctgctgctcaaccggttcaccatgacccaccgccggccgacgatcgagaaggacgtcgacctgggcgccggcacccgccacgtgaacgcggagcccgagacccccaacatggacgtcatcggggagcggatccgccggatcaaggaggagcactccagcacctggcactacgacgacgagaacccgtacaagacgtgggcctaccacggctcctacgaggtgaaggccaccgggagcgcctccagcatgatcaacggcgtggtcaagctgctcaccaagccctgggacgtggtgcccaccgtcacgcagatggccatgaccgacaccacccccttcgggcagcagcgcgtgttcaaggagaaggtggacacgcggaccccgaagcccatgcccggcacccgcaaggtcatggagatcaccgcggagtggctgtggcggacgctgggccgcaacaagcggccccgcctctgcacccgggaggagttcaccaagaaggtgcgcaccaacgccgccatgggggccgtgttcacggaggagaaccagtgggacagcgcgcgcgccgccgtcgaggacgaggagttctggaagctggtggaccgggagcgcgagctgcacaagctcggcaagtgcgggtcctgcgtgtacaacatgatgggcaagcgggagaagaagctgggggagttcggcaaggccaagggcagccgcgccatctggtacatgtggctgggggcgcggtacctcgagttcgaggccctgggcttcctgaacgaggaccactggttctcccgcgagaacagctactccggggtcgagggcgaggggctccacaagctgggctacatcctgcgggacatcagcaagatcccgggcggggccatgtacgccgacgacaccgccggctgggacacccgcatcaccgaggacgacctccacaacgaggagaagatcacgcagcagatggaccccgagcaccggcagctggcgaacgccatcttcaagctgacctaccagaacaaggtggtgaaggtccagcgccccacccccaaggggaccgtgatggacatcatctcccggaaggaccagcgcggcagcggccaggtggggacgtacggcctcaacaccttcaccaacatggaggcccagctgatccggcagatggagggggagggcgtcctgtccaagaccgacctcgagaacccgcacctgctggagaagaagatcacccagtggctcgagacgaagggggtggagcgcctgaagcggatggccatcagcggcgacgactgcgtggtcaagcccatcgacgaccgcttcgccaacgcgctgctcgccctgaacgacatgggcaaggtgcggaaggacatcccccagtggcagccctccaaggggtggcacgactggcagcaggtgccgttctgcagccaccacttccacgagctgatcatgaaggacggccgcaagctcgtcgtgccctgccggccccaggacgagctgatcgggcgcgcccggatctcccagggcgccgggtggagcctgaaggagaccgcctgcctcggcaaggcgtacgcccagatgtgggccctgatgtacttccaccgccgcgacctgcggctcgcctccaacgcgatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggaggacgtgccctacctgggcaagcgcgaggaccagtggtgcgggtccctcatcggcctgaccagccgggccacgtgggcccagaacatcctgaccgcgatccagcaggtccgcagcctcatcgggaacgaggagttcctggactacatgccgtccatgaagcggttccgcaaggaggaggagctggagggcgccatctggtga

SEQ ID NO: 9814 - RNA, 9873 nt, synthetic construct
  misc_feature 1..9873: note = derived and/or modified CDS sequence (opt1) from DENV-3__AB189127__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggcggacatggggtgcgtcatcaactggaagggcaaggagctcaagtgcggctccgggatcttcgtgaccaacgaggtgcacacctggacggagcagtacaagttccaggccgacagccccaagcggctggccaccgccatcgccggcgcgtgggagaacggggtctgcggcatccgctccaccacccgcatggagaacctgctctggaagcagatcgccaacgagctgaactacatcctgtgggagaacaacatcaagctcacggtggtggtcggggacatcatcggcgtgctggagcagggcaagcggaccctgacgccccagcccatggagctcaagtacagctggaagacctgggggaaggccaaggtggtcacggccgagatccagaactccagcttcatcatcgacggcccgaacacccccgagtgccccaacgcgtcccgcgcctggaacgtgtgggaggtggaggactacgggttcggcgtcttcaccaccaacatctggctgaagctgcgggagatgtacacgcagctctgcgaccaccgcctgatgagcgccgccgtgaaggacgagcgggccatccacgcggacatgggctactggatcgagagccagaagaacgggtcctggaagctggagaaggccagcctcatcgaggtgaagacctgcacctggcccaagtcccacaccctgtggagcaacggcgtcctggagtccgacatgatcatccccaagtccctcgccgggcccatctcccagcacaactaccgccccggctaccacacccagacggccgggccgtggcacctgggcaagctggagctcgacttcaactactgcgagggcaccaccgtggtgatcaccgagaactgcgggacgcggggccccagcctgcgcaccaccaccgtctccgggaagctgatccacgagtggtgctgccggagctgcacgctgccgcccctccgctacatgggcgaggacgggtgctggtacggcatggagatccggccgatcaacgagaaggaggagaacatggtgaagtccctggtgagcgccggctccgggaaggtcgacaacttcaccatgggcgtgctctgcctggcgatcctgttcgaggaggtgatgcgcgggaagttcggcaagaagcacatgatcgccgggatcctcttcatgttcgtcctgctgctcagcggccagatcacctggcgggacatggcccgcaccctgatcatgatcggctccaacgccagcgaccggatggggatgggcgtgacgtacctggccctcatcgcgaccttcaagatccagcccttcctggccctggggttcttcctccgcaagctgacctcccgggagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctggtcagcctgacgtgcagcaacaccatcttcaccctcaccgtggcctggcgcacggcgaccctgatcctggccgggatctccctcctgcccgtgtgccagagctccagcatgcggaagaccgactggctgccgatgaccgtcgccgccatgggcgtgccgcccctgcccctgttcatcttctccctgaaggacacgctcaagcgccgcagctggccgctgaacgagggggtcatggccgtgggcctggtgtccatcctcgcgagctccctgctgcggaacgacgtccccatggccggccccctcgtggccgggggcctgctgatcgcctgctacgtgatcaccgggaccagcgccgacctcaccgtcgagaaggcggccgacgtgacgtgggaggaggaggccgagcagaccggcgtgtcccacaacctgatgatcaccgtcgacgacgacgggaccatgcgcatcaaggacgacgagacggagaacatcctgaccgtgctcctgaagaccgccctgctcatcgtgagcggcatcttcccctactccatcccggccaccctgctggtctggcacacctggcagaagcagacgcagcggagcggcgtgctctgggacgtgcccagcccgcccgagacccagaaggcggagctggaggagggggtctaccgcatcaagcagcagggcatcttcgggaagacccaggtgggcgtgggggtccagaaggagggcgtgttccacaccatgtggcacgtgacgcggggcgccgtcctgacctacaacgggaagcgcctcgagccgagctgggcctccgtgaagaaggacctgatcagctacggcgggggctggcggctgtccgcccagtggcagaagggggaggaggtgcaggtcatcgcggtggagcccggcaagaaccccaagaacttccagaccatgcccggcatcttccagaccacgaccggggagatcggcgccatcgccctggacttcaagccggggaccagcggcagccccatcatcaaccgcgagggcaaggtggtcgggctctacggcaacggggtggtgaccaagaacggcgggtacgtctccggcatcgcccagacgaacgccgagcccgacggcccgacccccgagctggaggaggagatgttcaagaagcggaacctgaccatcatggacctccaccccgggagcggcaagacccgcaagtacctgcccgcgatcgtgcgggaggccatcaagcgccggctgcgcacgctcatcctggccccgacccgggtggtcgccgccgagatggaggaggcgctgaaggggctccccatccgctaccagaccaccgccacgaagtccgagcacaccggcaaggagatcgtggacctgatgtgccacgccaccttcaccatgcggctgctcagccccgtgcgcgtccccaactacaacctgatcatcatggacgaggcccacttcacggacccggcctccatcgcggcccgggggtacatcagcacccgcgtgggcatgggcgaggccgccgcgatcttcatgaccgccacgccgcccgggacggccgacgccttcccccagtccaacgccccgatccaggacgaggagcgggacatccccgagcgcagctggaactccggcaacgactggatcaccgacttcgcggggaagaccgtgtggttcgtccccagcatcaaggccggcaacgacatcgccaactgcctgcgcaagaacgggaagaaggtgatccagctctcccggaagaccttcgacacggagtaccagaagaccaagctgaacgactgggacttcgtggtcaccaccgacatcagcgagatgggcgccaacttcaaggccgaccgcgtgatcgacccccggcgctgcctgaagccggtgatcctcacggacggccccgagcgggtcatcctggcggggcccatgcccgtgaccgtggcctccgccgcccagcgccggggccgcgtcgggcggaacccgcagaaggagaacgaccagtacatcttcaccggccagcccctgaacaacgacgaggaccacgcccactggaccgaggcgaagatgctcctggacaacatcaacacgcccgaggggatcatccccgccctgttcgagccggagcgcgagaagtccgccgccatcgacggcgagtaccggctcaagggcgagagccgcaagaccttcgtggagctgatgcggcgcggggacctgcccgtgtggctcgcgcacaaggtcgccagcgagggcatcaagtacaccgaccggaagtggtgcttcgacggggagcgcaacaaccagatcctggaggagaacatggacgtggagatctggaccaaggagggcgagaagaagaagctgcggccccgctggctcgacgcccggacctactccgaccccctggccctgaaggagttcaaggacttcgccgcgggccgcaagagcatcgccctcgacctggtcacggagatcgggcgcgtgccgtcccacctggcccaccggacccgcaacgccctcgacaacctggtgatgctgcacaccagcgagcacggcgggcgggcctaccgccacgcggtcgaggagctccccgagaccatggagacgctgctgctcctgggcctgatgatcctcctgaccgggggcgccatgctgttcctcatcagcggcaagggggtgggcaagacctccatcgggctgatctgcgtggtcgccagctccggcatgctgtggatggccgacatccccctccagtggatcgccagcgcgatcgtgctggagttcttcatgatggtgctgctcatcccggagcccgagaagcagcggacgccccaggacaaccagctggcctacgtcgtgatcgggatcctgacgctcgccgccatcgtggccgcgaacgagatgggcctgctggagaccaccaagcgcgacctcggcatgtccaaggagcccggggtcgtgccgcccaccagctacctggacgtggacctgcaccccgcctccgcctggacgctctacgccgtcgcgaccaccgtgatcacccccatgctgcggcacacgatcgagaacagcaccgccaacgtgtccctggccgccatcgccaaccaggcggtcgtgctcatgggcctggacaaggggtggccgatcagcaagatggacctgggcgtgcccctcctggccctggggtgctactcccaggtcaaccccctcaccctgaccgccgccgtgctgctcctggtgacgcactacgccatcatcggccccggcctgcaggcgaaggccacccgcgaggcccagaagcggaccgccgccgggatcatgaagaacccgaccgtcgacggcatcatgacgatcgacctcgaccccgtgatctacgacagcaagttcgagaagcagctgggccaggtgatgctgctcgtcctgtgcgcggtgcagctgctcctgatgcgcacctcctgggccttctgcgaggccctgaccctcgccaccggccccatcacgaccctgtgggagggcagccccgggaagttctggaacaccaccatcgcggtgtccatggccaacatcttccggggcagctacctggccggggccggcctcgccttctccatcatgaagtccgtcgggacgggcaagcgcggcaccgggtcccagggcgagaccctgggggagaagtggaagaagaagctgaaccagctcagccggaaggagttcgacctgtacaagaagtccggcatcaccgaggtggaccgcacggaggcgaaggaggggctgaagcggggcgagatcacccaccacgccgtgtcccgcggcagcgccaagctccagtggttcgtcgagcggaacatggtgatcccggaggggcgcgtgatcgacctgggctgcgggcggggcgggtggtcctactactgcgccggcctgaagaaggtcaccgaggtgcgcggctacaccaagggcgggcccgggcacgaggagcccgtgcccatgagcacctacggctggaacatcgtcaagctcatgtccgggaaggacgtgttctacctgccgcccgagaagtgcgacacgctgctgtgcgacatcggcgagagctcccccagccccaccgtggaggagtcccggaccatccgcgtcctcaagatggtggagccgtggctgaagaacaaccagttctgcatcaaggtgctgaacccctacatgcccaccgtcatcgagcacctcgagcgcctgcagcggaagcacggcgggatgctggtgcgcaaccccctcagccggaactccacgcacgagatgtactggatcagcaacggcaccgggaacatcgtgtccagcgtcaacatggtgtcccgcctgctgctcaaccggttcaccatgacccaccgccggccgacgatcgagaaggacgtggacctgggcgccggcacccgccacgtcaacgcggagcccgagacccccaacatggacgtgatcggggagcggatccgccggatcaaggaggagcacagctccacctggcactacgacgacgagaacccgtacaagacgtgggcctaccacggcagctacgaggtcaaggccaccgggtccgccagcagcatgatcaacggcgtggtgaagctgctcaccaagccctgggacgtcgtgcccaccgtgacgcagatggccatgaccgacaccacccccttcgggcagcagcgcgtcttcaaggagaaggtggacacgcggaccccgaagcccatgcccggcacccgcaaggtgatggagatcaccgcggagtggctgtggcggacgctgggccgcaacaagcggccccgcctctgcacccgggaggagttcaccaagaaggtccgcaccaacgccgccatgggggccgtgttcacggaggagaaccagtgggactccgcgcgcgccgccgtggaggacgaggagttctggaagctggtcgaccgggagcgcgagctgcacaagctcggcaagtgcgggagctgcgtgtacaacatgatgggcaagcgggagaagaagctgggggagttcggcaaggccaagggctcccgcgccatctggtacatgtggctgggggcgcggtacctcgagttcgaggccctgggcttcctgaacgaggaccactggttcagccgcgagaactcctacagcggggtggagggcgaggggctccacaagctgggctacatcctgcgggacatctccaagatcccgggcggggccatgtacgccgacgacaccgccggctgggacacccgcatcaccgaggacgacctccacaacgaggagaagatcacgcagcagatggaccccgagcaccggcagctggcgaacgccatcttcaagctgacctaccagaacaaggtcgtgaaggtgcagcgccccacccccaaggggaccgtcatggacatcatcagccggaaggaccagcgcggctccggccaggtggggacgtacggcctcaacaccttcaccaacatggaggcccagctgatccggcagatggagggggagggcgtgctgagcaagaccgacctcgagaacccgcacctcctggagaagaagatcacccagtggctcgagacgaagggggtcgagcgcctgaagcggatggccatctccggcgacgactgcgtggtgaagcccatcgacgaccgcttcgccaacgcgctgctcgccctgaacgacatgggcaaggtccggaaggacatcccccagtggcagcccagcaaggggtggcacgactggcagcaggtcccgttctgctcccaccacttccacgagctgatcatgaaggacggccgcaagctcgtggtcccctgccggccccaggacgagctgatcgggcgcgcccggatcagccagggcgccgggtggtccctgaaggagaccgcctgcctcggcaaggcgtacgcccagatgtgggccctgatgtacttccaccgccgcgacctgcggctcgccagcaacgcgatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggaggacaagacgcccgtcaccacctgggaggacgtgccctacctgggcaagcgcgaggaccagtggtgcgggagcctcatcggcctgaccagccgggccacgtgggcccagaacatcctgaccgcgatccagcaggtccgctccctcatcgggaacgaggagttcctggactacatgccgagcatgaagcggttccgcaaggaggaggagctggagggcgccatctggtga

SEQ ID NO: 9815 - RNA, 9873 nt, synthetic construct
  misc_feature 1..9873: note = derived and/or modified CDS sequence (opt1) from DENV-3__AB189128__SS-prME
  source 1..9873: mol_type = other RNA
accagcctgtgcctcatgatgatcctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcacccagacgtggatgagcgcggagggcgcctggcggcaggtggagaaggtcgagacctgggccttccgccacccggggttcaccgtgctcgccctgttcctggcgcacttcatcggcacctccctcacgcagaaggtggtcatcttcatcctgctgatgctcgtgacccccagcatgaccatgcggtgcgtgggggtcggcaaccgcgacttcgtggagggcctgtccggggccacctgggtggacgtcgtgctggagcacggcgggtgcgtgacgaccatggccaagaacaagcccaccctcgacatcgagctgcagaagaccgaggccacgcagctggccaccctccggaagctgtgcatcgagggcaagatcaccaacgtcaccacggacagccgctgccccacccagggcgaggcgatcctgccggaggagcaggaccagaactacgtgtgcaagcacacctacgtggaccgggggtggggcaacgggtgcggcctcttcgggaagggctccctggtcacctgcgccaagttccagtgcctggagagcatcgagggcaaggtggtgcagcacgagaacctcaagtacacggtcatcatcaccgtgcacaccggggaccagcaccaggtcggcaacgagacccagggggtgacggccgagatcaccccccaggcctccaccgtggaggccatcctgcccgagtacggcaccctggggctcgagtgcagcccccgcaccggcctggacttcaacgagatgatcctgctcacgatgaagaacaaggcgtggatggtccaccggcagtggttcttcgacctgccgctgccctggacctccggcgccaccaccgagacgcccacctggaacaagaaggagctcctggtgaccttcaagaacgcccacgccaagaagcaggaggtggtcgtgctggggagccaggagggcgccatgcacaccgcgctcacgggggccaccgagatccagacctccggcgggaccagcatcttcgccggccacctgaagtgccgcctgaagatggacaagctcgagctgaagggcatgtcctacgccatgtgcctgaacgccttcgtgctcaagaaggaggtcagcgagacgcagcacgggaccatcctgatcaaggtggagtacaagggcgaggacgcgccctgcaagatcccgttcagcaccgaggacgggcagggcaaggcccacaacggccggctgatcaccgccaaccccgtggtcacgaagaaggaggagcccgtgaacatcgaggccgagcccccgttcggggagtccaacatcgtgatcggcatcggggacaaggcgctgaagatcaactggtacaagaagggcagctccatcgggaagatgttcgaggccaccgcccgcggcgcccggcgcatggccatcctcggcgacaccgcgtgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggccgacaccgggtgcgtgatcaactggaagggcaaggagctcaagtgcggctccgggatcttcgtcacgaacgaggtgcacacctggaccgagcagtacaagttccaggcggacagccccaagcggctggccaccgccatcgccggcgcctgggagaacggggtgtgcggcatccgctccacgacccgcatggagaacctgctctggaagcagatcgcgaacgagctgaactacatcctgtgggagaacaacatcaagctcaccgtcgtggtgggggacatcatcggcgtcctggagcagggcaagcggaccctgacgccccagcccaccgagctcaagtacagctggaagacctgggggaaggccaagatcgtgaccgccgagacgcagaactccagcttcatcatcgacggcccgaacacccccgagtgcccctccgccagccgcgcgtggaacgtgtgggaggtcgaggagtacgggttcggcgtgttcaccaccaacatctggctgaagctgcgggagatgtacacccagctctgcgaccaccgcctgatgagcgccgccgtgaaggacgagcgggccgtccacgccgacatgggctactggatcgagtcccagaagaacgggagctggaagctggagaaggcgtccctcatcgaggtgaagacgtgcacctggcccaagagccacaccctgtggtccaacggcgtgctggagagcgacatgatcatcccgaagtccctcgccgggcccatcagccagcacaactaccgccccggctaccacacccagacggccgggccgtggcacctgggcaagctggagctcgacttcaactactgcgagggcaccaccgtcgtgatcaccgagaactgcgggacgcggggcccctccctgcgcaccaccaccgtgagcgggaagctgatccacgagtggtgctgccggtcctgcacgctcccccccctgcgctacatgggcgaggacgggtgctggtacggcatggagatccggccgatcaacgagaaggaggagaacatggtcaagagcctggtgtccgccggcagcgggaaggtggacaacttcaccatgggcgtcctctgcctggccatcctgttcgaggaggtgatgcgcgggaagttcggcaagaagcacatgatcgcgggggtgctcttcaccttcgtcctgctgctctccggccagatcacctggcgggacatggcccgcacgctgatcatgatcggcagcaacgcctccgaccggatggggatgggcgtgacctacctggccctcatcgccaccttcaagatccagcccttcctggcgctggggttcttcctccgcaagctgaccagccgggagaacctgctcctgggcgtgggcctggccatggccacgaccctccagctgcccgaggacatcgagcagatggccaacgggatcgcgctgggcctcatggccctgaagctgatcacccagttcgagacctaccagctctggacggccctggtcagcctgatgtgctccaacaccatcttcaccctcaccgtggcctggcgcacggccaccctgatcctggcggggatcagcctcctgcccgtctgccagtccagctccatgcggaagaccgactggctgccgatgaccgtggccgccatgggcgtgccccccctccccctgttcatcttcagcctgaaggacacgctcaagcgccgctcctggccgctgaacgagggggtcatggccgtgggcctggtgagcatcctcgcctccagcctgctgcggaacgacgtccccatggcgggccccctcgtggccgggggcctgctgatcgcctgctacgtgatcaccgggacctccgccgacctcaccgtcgagaaggccgcgaacgtgacgtgggaggaggaggccgagcagaccggcgtgagccacaacctgatgatcaccgtcgacgacgacgggaccatgcgcatcaaggacgacgagaccgagaacatcctgacggtgctcctgaagaccgccctgctcatcgtgtccggcatcttcccctacagcatcccggccaccctgctggtctggcacacctggcagaagcagacgcagcggtccggcgtgctctgggacgtgcccagcccccccgagacccagaaggccgagctggaggacggggtctaccgcatcaagcagcagggcatcttcgggaagacccaggtgggcgtgggggtccagaaggagggcgtgttccacaccatgtggcacgtgacgcggggcgcggtcctgacccacaacgggaagcgcctcgagccgaactgggcctccgtgaagaaggacctgatcagctacggcgggggctggcggctgtccgcccagtggcagaagggggaggaggtgcaggtcatcgccgtggagcccggcaagaaccccaagaacttccagaccatgcccggcatcttccagaccacgaccggggagatcggcgcgatcgccctggacttcaagccggggaccagcggcagccccatcatcaaccgcgagggcaaggtggtcgggctctacggcaacggggtggtgaccaagaacggcgggtacgtctccggcatcgcccagacgaacgccgagcccgacggcccgacccccgagctggaggaggagatgttcaagaagcggaacctgaccatcatggacctccaccccgggagcggcaagacccgcaagtacctgcccgccatcgtgcgggaggcgatcaagcgccggctgcgcacgctcatcctggccccgacccgggtggtcgccgccgagatggaggaggccctgaaggggctccccatccgctaccagaccaccgcgacgaagtccgagcacaccggcaaggagatcgtggacctgatgtgccacgccaccttcaccatgcggctgctcagccccgtgcgcgtccccaactacaacctgatcatcatggacgaggcccacttcacggacccggcctccatcgccgcgcgggggtacatcagcacccgcgtgggcatgggcgaggccgccgccatcttcatgaccgcgaccccccccgggacggccgacgccttcccccagtccaacgccccgatccaggacgaggagcgggacatccccgagcgcagctggaactccggcaacgagtggatcaccgacttcgccgggaagaccgtgtggttcgtccccagcatcaaggcgggcaacgacatcgccaactgcctgcgcaagaacgggaagaaggtgatccagctctcccggaagaccttcgacacggagtaccagaagaccaagctgaacgactgggacttcgtggtcaccaccgacatcagcgagatgggcgccaacttcaaggccgaccgcgtgatcgacccccggcgctgcctgaagccggtgatcctcacggacggccccgagcgggtcatcctggccgggcccatgcccgtgaccgtggcgtccgccgcccagcgccggggccgcgtcgggcggaacccgcagaaggagaacgaccagtacatcttcaccggccagcccctgaacaacgacgaggaccacgcccactggaccgaggccaagatgctcctggacaacatcaacacccccgaggggatcatccccgcgctgttcgagccggagcgcgagaagagcgccgccatcgacggcgagtaccggctcaagggcgagtcccgcaagacgttcgtggagctgatgcggcgcggggacctgcccgtctggctcgcccacaaggtggcgagcgagggcatcaagtacaccgaccggaagtggtgcttcgacggggagcgcaacaaccagatcctggaggagaacatggacgtggagatctggaccaaggagggcgagaagaagaagctgcggccccgctggctcgacgcccggacctactccgaccccctggccctgaaggagttcaaggacttcgccgccggccgcaagagcatcgcgctcgacctggtcacggagatcgggcgcgtgccgtcccacctggcccaccggacccgcaacgccctcgacaacctggtgatgctgcacaccagcgagcacggcgggcgggcctaccgccacgccgtcgaggagctccccgagaccatggagacgctgctgctcctgggcctgatgatcctcctgaccgggggcgcgatgctgttcctcatcagcggcaaggggatcggcaagacctccatcgggctgatctgcgtggtggccagctccggcatgctgtggatggccgacgtccccctccagtggatcgccagcgccatcgtgctggagttcttcatgatggtgctgctcatcccggagcccgagaagcagcggaccccccaggacaaccagctggcgtacgtcgtgatcgggatcctgacgctcgccgccatcgtggccgccaacgagatgggcctgctggagaccaccaagcgcgacctcggcatgtccaaggagcccggggtcgtgagcccgatctcctacctggacgtggacctgcaccccgcgagcgcctggaccctctacgccgtcgccacgaccgtgatcacccccatgctgcggcacaccatcgagaactccacggcgaacgtgagcctggccgccatcgccaaccaggccgtcgtgctcatgggcctggacaaggggtggcccatctccaagatggacctgggcgtgccgctcctggcgctggggtgctacagccaggtcaaccccctcaccctgaccgccgccgtgctgctcctggtgacccactacgccatcatcggccccggcctgcaggccaaggcgacgcgcgaggcccagaagcggaccgccgccgggatcatgaagaaccccaccgtcgacggcatcatgaccatcgacctcgacccggtgatctacgactccaagttcgagaagcagctggggcaggtgatgctgctcatcctgtgcgccgtccagctgctcctgatgcgcacgagctgggcgttctgcgaggccctgaccctcgccaccggccccatcaccacgctgtgggagggctcccccgggaagttctggaacaccaccatcgccgtgagcatggcgaacatcttccggggctcctacctggccggggccggcctcgccttcagcatcatgaagtccgtggggaccggcaagcgcggcacggggagccagggcgagaccctgggggagaagtggaagaagaagctgaaccagctcagccggaaggagttcgacctgtacaagaagtccggcatcaccgaggtcgaccgcaccgaggccaaggaggggctgaagcggggcgagatcacccaccacgcggtgagccgcggctccgccaagctccagtggttcgtggagcggaacatggtcatccccgaggggcgcgtgatcgacctgggctgcgggcggggcgggtggagctactactgcgccggcctgaagaaggtgacggaggtccgcggctacaccaaggggggcccggggcacgaggagcccgtgcccatgtccacctacggctggaacatcgtgaagctcatgagcgggaaggacgtcttctacctgcccccggagaagtgcgacaccctgctgtgcgacatcggcgagtccagcccctcccccacggtggaggagagccggaccatccgcgtgctcaagatggtcgagccctggctgaagaacaaccagttctgcatcaaggtgctgaacccgtacatgcccaccgtgatcgagcacctcgagcgcctgcagcggaagcacggcgggatgctggtccgcaaccccctctcccggaacagcacccacgagatgtactggatctccaacggcacggggaacatcgtgagctccgtgaacatggtcagccgcctgctgctcaaccggttcaccatgacccaccgccggcccaccatcgagaaggacgtggacctgggcgccggcacgcgccacgtcaacgccgagccggagacccccaacatggacgtgatcggggagcggatccgccggatcaaggaggagcactccagcacctggcactacgacgacgagaacccctacaagacctgggcgtaccacggctcctacgaggtgaaggccacggggagcgccagctccatgatcaacggcgtcgtgaagctgctcaccaagccgtgggacgtggtccccaccgtgacccagatggccatgacggacaccacccccttcgggcagcagcgcgtgttcaaggagaaggtcgacacccggacgccccgcccgatgcccggcacccggaaggtgatggagatcaccgccgagtggctgtggcgcaccctgggccggaacaagcgcccccggctctgcacgcgcgaggagttcaccaagaaggtgcgcaccaacgcggccatgggggccgtcttcaccgaggagaaccagtgggacagcgcccgggcggccgtggaggacgaggagttctggaagctggtggaccgcgagcgggagctgcacaagctcggcaagtgcgggtcctgcgtctacaacatgatgggcaagcgcgagaagaagctgggggagttcggcaaggccaagggcagccgggccatctggtacatgtggctgggggcccgctacctcgagttcgaggcgctgggcttcctgaacgaggaccactggttctcccgggagaacagctactccggggtggagggcgaggggctccacaagctgggctacatcctgcgcgacatcagcaagatccccggcggggccatgtacgccgacgacacggccggctgggacacccggatcaccgaggacgacctccacaacgaggagaagatcacccagcagatggacccggagcaccgccagctggccaacgcgatcttcaagctgacgtaccagaacaaggtggtcaaggtgcagcggcccacccccaaggggaccgtgatggacatcatctcccgcaaggaccagcggggcagcggccaggtcgggacctacggcctcaacaccttcacgaacatggaggcccagctgatccgccagatggagggggagggcgtgctgtccaaggccgacctcgagaacccccacctgctggagaagaagatcacccagtggctcgaggccgagggggtggagcggctgaagcgcatggccatcagcggcgacgactgcgtcgtgaagccgatcgacgaccggttcgcgaacgccctgctcgccctgaacgacatgggcaaggtgcgcaaggacatcccccagtggcagccctccaaggggtggcacgactggcagcaggtccccttctgcagccaccacttccacgagctgatcatgaaggacggccggaagctcgtggtgccgtgccgcccccaggacgagctgatcgggcgggcccgcatctcccagggcgccgggtggagcctgaaggagaccgcgtgcctcggcaaggcctacgcccagatgtgggccctgatgtacttccaccgccgggacctgcgcctcgcgtccaacgccatctgcagcgccgtccccgtgcactgggtgcccacctcccggacgacctggagcatccacgcccaccaccagtggatgaccaccgaggacatgctgacggtctggaaccgcgtgtggatcgaggacaacccgtggatggaggacaagacccccgtgaccacctgggaggacgtcccctacctgggcaagcgggaggaccagtggtgcgggagcctcatcggccacacgtcccgcgccacctgggcgcagaacatcctgaccgccatccagcaggtgcggagcctgatcgggaacgaggagttcctcgactacatgccctccatgaagcgcttccggaaggaggaggagagcgagggcgccatctggtga

SEQ ID NO: 9816 - RNA, 9873 nt, synthetic construct
  misc_feature 1..9873: note = derived and/or modified CDS sequence (opt1) from DENV-3__AB214879__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacgtggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagcacgagaacctcaagtacacggtgatcatcaccgtccacaccggggaccagcaccaggtgggcaacgagacccagggggtcacggccgagatcacgccccaggcctccaccgtggaggccgtgctgcccgagtacggcaccctggggctcgagtgcagcccccgcaccggcctggacttcaacgagatgatcctgctcacgatgaagaacaaggcgtggatggtccaccggcagtggttcttcgacctgccgctgccctggacctccggcgccaccaccgagacgcccacctggaacaagaaggagctcctggtgaccttcaagaacgcccacgccaagaagcaggaggtggtcgtgctggggagccaggagggcgccatgcacaccgcgctcacgggggccaccgagatccagacctccggcgggaccagcgtgttcgccggccacctgaagtgccgcctgaagatggacaagctcgagctgaagggcatgtcctacgccatgtgcagcaacgccttcgtcctgaagaaggaggtgagcgagacgcagcacgggaccatcctcatcaaggtggagtacaagggcgaggacgcgccctgcaagatcccgttctccaccgaggacgggcagggcaaggcccacaacggccggctgatcaccgccaaccccgtcgtgacgaagaaggaggagcccgtgaacatcgaggccgagcccccgttcggggagagcaacatcatcatcggcatcggggacaaggcgctgaagatcaactggtacaagaagggctccagcatcgggaagatgttcgaggccaccgcccgcggcgcccggcgcatggccatcctgggcgacaccgcgtgggacttcgggtccgtcggcggggtgctcaacagcctgggcaagatggtgcaccagatcttcgggtccgcctacaccgccctgttcagcggcgtctcctggatcatgaagatcggcatcggggtgctcctgacgtggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcaccaacgaggtgcacacgtggaccgagcagtacaagttccaggcggactcccccaagcggctcgccaccgccatcgccggcgcctgggagaacggggtgtgcggcatccgcagcaccacgcgcatggagaacctgctgtggaagcagatcgcgaacgagctcaactacatcctgtgggagaacaacatcaagctgaccgtcgtggtgggggacatcatcggcgtcctcgagcagggcaagcggaccctgacgccccagcccatggagctgaagtactcctggaagacgtgggggaaggccaagatcgtgaccgccgagacccagaacagctccttcatcatcgacggcccgaacacccccgagtgccccagcgccagccgcgcgtggaacgtgtgggaggtcgaggactacgggttcggcgtgttcacgaccaacatctggctcaagctgcgggagatgtacacccagctgtgcgaccaccgcctcatgtccgccgccgtgaaggacgagcgggccgtccacgccgacatgggctactggatcgagagccagaagaacgggtcctggaagctggagaaggcgagcctgatcgaggtgaagacctgcacctggcccaagtcccacacgctctggagcaacggcgtgctggagtccgacatgatcatccccaagagcctggccgggcccatctcccagcacaactaccgccccggctaccacacccagaccgccgggccgtggcacctcggcaagctggagctggacttcaactactgcgagggcaccacggtcgtgatcaccgagaactgcgggacccggggccccagcctccgcaccacgaccgtgtccgggaagctgatccacgagtggtgctgccggagctgcaccctgccgcccctgcgctacatgggcgaggacgggtgctggtacggcatggagatccggccgatcaacgagaaggaggagaacatggtcaagtccctggtgagcgccggctccgggaaggtggacaacttcaccatgggcgtcctgtgcctcgccatcctgttcgaggaggtgatgcgcgggaagttcggcaagaagcacatgatcgcgggggtgctgttcacgttcgtcctcctgctgagcggccagatcacctggcgggacatggcccgcaccctcatcatgatcggctccaacgccagcgaccggatggggatgggcgtgacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatggccctcaagctgatcacgcagttcgagacctaccagctgtggaccgccctcacctccctgatgtgcagcaacacgatcttcaccctgaccgtcgcctggcgcaccgccacgctcatcctggcggggatctccctgctccccgtgtgccagagctccagcatgcggaagaccgactggctgccgatgaccgtcgccgccatgggcgtgccgcccctccccctcttcatcttctccctgaaggacaccctgaagcgccgcagctggccgctcaacgagggggtgatggccgtcggcctggtgtccatcctggccagctccctcctgcggaacgacgtgcccatggcgggccccctggtcgccgggggcctcctgatcgcctgctacgtgatcacggggaccagcgccgacctgaccgtggagaaggccgcggacgtcacctgggaggaggaggccgagcagacgggcgtgtcccacaacctcatgatcaccgtggacgacgacgggaccatgcgcatcaaggacgacgagaccgagaacatcctgaccgtcctgctcaagacggccctgctgatcgtgagcggcatcttcccctactccatcccggccaccctcctggtgtggcacacctggcagaagcagacccagcggagcggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgcggtgctgacgcacaacgggaagcgcctggagccgaactgggccagcgtcaagaaggacctcatctcctacggcgggggctggcggctgagcgcccagtggcagaagggggaggaggtccaggtgatcgccgtcgagcccggcaagaaccccaagaacttccagaccatgcccggcatcttccagaccaccacgggggagatcggcgcgatcgccctggacttcaagccggggaccagcggctcccccatcatcaaccgcgagggcaaggtggtggggctgtacggcaacggggtcgtgaccaagagcggcgggtacgtgtccggcatcgcccagaccaacgccgagcccgacggcccgacgcccgagctcgaggaggagatgttcaagaagcggaacctgaccatcatggacctgcaccccgggagcggcaagacccgcaagtacctccccgccatcgtccgggaggcgatcaagcgccggctgcgcaccctgatcctcgccccgacgcgggtggtggccgccgagatggaggaggccctgaaggggctgcccatccgctaccagaccaccgcgaccaagtccgagcacacgggcaaggagatcgtcgacctcatgtgccacgccaccttcaccatgcggctgctgagccccgtgcgcgtgcccaactacaacctcatcatcatggacgaggcccacttcaccgacccggcctccatcgccgcgcgggggtacatcagcacgcgcgtcggcatgggcgaggccgccgccatcttcatgaccgcgacgccgcccgggaccgccgacgccttcccccagtccaacgccccgatccaggacgaggagcgggacatccccgagcgcagctggaactccggcaacgactggatcacggacttcgccgggaagaccgtgtggttcgtgcccagcatcaaggcgggcaacgacatcgccaactgcctgcgcaagaacgggaagaaggtcatccagctgtcccggaagaccttcgacaccgagtaccagaagacgaagctcaacgactgggacttcgtggtgaccaccgacatcagcgagatgggcgccaacttcaaggccgaccgcgtcatcgacccccggcgctgcctgaagccggtgatcctgaccgacggccccgagcgggtgatcctcgccgggcccatgcccgtcacggtggcgtccgccgcccagcgccggggccgcgtggggcggaacccgcagaaggagaacgaccagtacatcttcaccggccagcccctgaacaacgacgaggaccacgcccactggaccgaggccaagatgctgctcgacaacatcaacacccccgaggggatcatccccgcgctgttcgagccggagcgcgagaagtccgccgccatcgacggcgagtaccggctgaagggcgagtcccgcaagaccttcgtcgagctcatgcggcgcggggacctgcccgtgtggctggcccacaaggtcgcgagcgagggcatcaagtacacggaccggaagtggtgcttcgacggggagcgcaacaaccagatcctcgaggagaacatggacgtggagatctggaccaaggagggcgagaagaagaagctgcggccccgctggctggacgcccggacctactccgaccccctcgccctgaaggagttcaaggacttcgccgccggccgcaagagcatcgcgttcgacctggtgaccgagatcgggcgcgtcccgagccacctcgcccaccggacgcgcaacgccctggacaacctggtgatgctccacacctccgagcacggcgggcgggcctaccgccacgccgtggaggagctgcccgagaccatggagaccctgctcctgctgggcctcatgatcctgctgaccggcggggcgatgctgttcctgatcagcgggaaggggatcggcaagacctccatcgggctgatctgcgtcgtggccagctccggcatgctctggatggccgacatccccctgcagtggatcgccagcgccatcgtgctggagttcttcatgatggtcctcctgatcccggagcccgagaagcagcggacgccccaggacaaccagctggcgtacgtggtgatcgggatcctcaccctggccgccatcgtcgccgccaacgagatgggcctgctcgagacgaccaagcgcgacctgggcatgtccaaggagcccggggtggtgagcccgacctcctacctggacgtcgacctccaccccgcgagcgcctggaccctgtacgccgtggccacgaccgtgatcacccccatgctgcggcacaccatcgagaactccacggcgaacgtcagcctcgccgccatcgccaaccaggccgtggtgctgatgggcctggacaaggggtggcccatctccaagatggacctcggcgtcccgctgctggcgctcgggtgctacagccaggtgaaccccctgaccctgaccgccgccgtgctcctgctggtcacccactacgccatcatcggccccggcctccaggccaaggcgacgcgcgaggcccagaagcggaccgccgccgggatcatgaagaaccccaccgtggacggcatcatgaccatcgacctggacccggtgatctacgactccaagttcgagaagcagctggggcaggtcatgctcctggtgctgtgcgccgtgcagctcctgctgatgcgcacgagctgggcgttctgcgaggccctcaccctggccaccggccccatcaccacgctgtgggagggctcccccgggaagttctggaacaccaccatcgccgtcagcatggcgaacatcttccggggctcctacctcgccggggccggcctggccttcagcatcatgaagtccgtggggaccggcaagcgcggcacggggtcccagggcgagaccctgggggagaagtggaagaagaagctcaaccagctgagccggaaggagttcgacctgtacaagaagtccggcatcaccgaggtggaccgcaccgaggccaaggaggggctcaagcggggcgagatcacccaccacgcggtcagccgcggctccgccaagctgcagtggttcgtggagcggaacatggtgatccccgaggggcgcgtcatcgacctgggctgcgggcggggcgggtggagctactactgcgccggcctcaagaaggtgacggaggtgcgcggctacaccaagggcggcccggggcacgaggagcccgtccccatgtccacctacggctggaacatcgtgaagctgatgagcgggaaggacgtgttctacctgcccccggagaagtgcgacaccctcctgtgcgacatcggcgagtccagcccctcccccacggtcgaggagagccggaccatccgcgtgctgaagatggtggagccctggctgaagaacaaccagttctgcatcaaggtcctcaacccgtacatgcccaccgtgatcgagcacctggagcgcctgcagcggaagcacggcgggatgctcgtgcgcaaccccctgtcccggaacagcacccacgagatgtactggatctccaacggcacggggaacatcgtcagctccgtgaacatggtgagccgcctgctcctgaaccggttcaccatgacctaccgccggcccaccatcgagaaggacgtcgacctgggcgccggcacgcgccacgtgaacgccgagccggagacccccaacatggacgtcatcggggagcggatccgccggatcaaggaggagcactccagcacctggcactacgacgacgagaacccctacaagacctgggcgtaccacggcagctacgaggtgaaggccacggggtccgccagctccatgatcaacggcgtggtcaagctcctgaccaagccgtgggacgtggtgcccaccgtcacccagatggccatgacggacaccacccccttcgggcagcagcgcgtgttcaaggagaaggtggacacccggacgcccaagccgatgcccggcacccgcaaggtcatggagatcaccgccgagtggctgtggcggaccctcggccgcaacaagcggccccgcctgtgcacgcgggaggagttcaccaagaaggtgcgcaccaacgcggccatgggggccgtgttcaccgaggagaaccagtgggacagcgcccgcgcggccgtcgaggacgaggagttctggaagctggtggaccgggagcgcgagctccacaagctgggcaagtgcgggtcctgcgtgtacaacatgatgggcaagcgggagaagaagctgggggagttcggcaaggccaagggcagccgcgccatctggtacatgtggctcggggcccggtacctggagttcgaggcgctgggcttcctcaacgaggaccactggttctcccgcgagaacagctactccggggtcgagggcgaggggctgcacaagctgggctacatcctccgggacatcagcaagatccccggcggggccatgtacgccgacgacacggccggctgggacacccgcatcaccgaggacgacctgcacaacgaggagaagatcacccagcagatggacccggagcaccggcagctggccaacgcgatcttcaagctcacgtaccagaacaaggtggtgaaggtccagcgccccacccccaaggggaccgtgatggacatcatctcccggaaggaccagcgcggcagcggccaggtggggacctacggcctgaacaccttcacgaacatggaggcccagctgatccggcagatggagggggagggcgtcctctccaagaccgacctggagaacccccacctcctcgagaagcgcatcacccagtggctggagaccaagggggtggagcggctgaagcgcatggccatcagcggcgacgactgcgtggtcaagccgatcgacgaccggttcgccaacgccctcctggcgctgaacgacatgggcaaggtgcgcaaggacatcccccagtggcagccctccaaggggtggcacgactggcagcaggtccccttctgcagccaccacttccacgagctcatcatgaaggacggccggaagctggtcgtgccgtgccgcccccaggacgagctgatcgggcgggcccgcatctcccagggcgccgggtggagcctcaaggagacggcctgcctgggcaaggcctacgcgcagatgtgggccctgatgtacttccaccgccgggacctccgcctggcctccaacgccatctgcagcgcggtgcccgtccactgggtgcccaccagccggaccacctggtccatccacgcccaccaccagtggatgacgaccgaggacatgctgaccgtgtggaaccgcgtctggatcgaggacaacccgtggatggaggacaagacccccgtgacgacctgggaggacgtgccctacctcggcaagcgggaggaccagtggtgcgggagcctgatcggcctgacctcccgcgccacctgggcccagaacatcctcacggccatccagcaggtccggagcctgatcgggaacgaggagttcctggactacatgccctccatgaagcgcttccggaaggaggaggagagcgagggcgcgatctggtga

SEQ ID NO: 9817 - RNA, 9873 nt, synthetic construct
  misc_feature 1..9873: note = derived and/or modified CDS sequence (opt1) from DENV-3__AB214880__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcacccagacgtggatgagcgcggagggcgcctggcggcaggtggagaaggtcgagacctgggccttccgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgccggaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagcacgagaacctcaagtacacggtgatcatcaccgtccacaccggggaccagcaccaggtgggcaacgagacccagggggtcacggccgagatcaccccccaggcctccaccgtggaggccgtgctgcccgagtacggcaccctggggctcgagtgcagcccccgcaccggcctggacttcaacgagatgatcctgctcacgatgaagaacaaggcgtggatggtccaccggcagtggttcttcgacctgccgctgccctggacctccggcgccaccaccgagacgcccacctggaacaagaaggagctcctggtgaccttcaagaacgcccacgccaagaagcaggaggtggtcgtgctggggagccaggagggcgccatgcacaccgcgctcacgggggccaccgagatccagacctccggcgggaccagcatcttcgccggccacctgaagtgccgcctgaagatggacaagctcgagctgaagggcatgtcctacgccatgtgcagcaacgccttcgtgctgaagaaggaggtcagcgagacgcagcacgggaccatcctcatcaaggtggagtacaagggcgaggacgcgccctgcaagatcccgttctccaccgaggacgggcagggcaaggcccacaacggccggctgatcaccgccaaccccgtggtcacgaagaaggaggagcccgtgaacatcgaggccgagcccccgttcggggagagcaacatcatcatcggcatcggggacaaggcgctgaagatcaactggtacaagaagggctccagcatcgggaagatgttcgaggccaccgcccgcggcgcccggcgcatggccatcctgggcgacaccgcgtgggacttcgggtccgtgggcggggtcctcaacagcctgggcaagatggtgcaccagatcttcgggtccgcctacaccgccctgttcagcggcgtgtcctggatcatgaagatcggcatcggggtcctcctgacgtggatcggcctgaacagcaagaacacctccatgagcttctcctgcatcgtgatcgggatcatcaccctctacctgggcgccgtggtccaggccgacatggggtgcgtgatcaactggaagggcaaggagctgaagtgcggcagcgggatcttcgtgaccaacgaggtccacacgtggaccgagcagtacaagttccaggcggactcccccaagcggctcgccaccgccatcgccggcgcctgggagaacggggtgtgcggcatccgcagcaccacgcgcatggagaacctgctgtggaagcagatcgcgaacgagctcaactacatcctgtgggagaacaacatcaagctgaccgtggtcgtgggggacatcatcggcgtgctcgagcagggcaagcggaccctgaccccccagcccatggagctgaagtactcctggaagacgtgggggaaggccaagatcgtcaccgccgagacccagaacagctccttcatcatcgacggcccgaacacccccgagtgccccagcgccagccgcgcgtggaacgtgtgggaggtggaggactacgggttcggcgtcttcacgaccaacatctggctcaagctgcgggagatgtacacccagctgtgcgaccaccgcctcatgtccgccgccgtgaaggacgagcgggccgtgcacgccgacatgggctactggatcgagagccagaagaacgggtcctggaagctggagaaggcgagcctgatcgaggtcaagacctgcacctggcccaagtcccacacgctctggagcaacggcgtgctggagtccgacatgatcatcccgaagagcctggccgggcccatctcccagcacaactaccgccccggctaccacacccagaccgccgggccgtggcacctcggcaagctggagctggacttcaactactgcgagggcaccacggtggtcatcaccgagaactgcgggacccggggccccagcctccgcaccacgaccgtgtccgggaagctgatccacgagtggtgctgccggagctgcaccctgccccccctccgctacatgggcgaggacgggtgctggtacggcatggagatccggccgatcaacgagaaggaggagaacatggtgaagtccctggtcagcgccggctccgggaaggtggacaacttcaccatgggcgtgctgtgcctcgccatcctgttcgaggaggtcatgcgcgggaagttcggcaagaagcacatgatcgcgggggtgctgttcacgttcgtgctcctgctgagcggccagatcacctggcgggacatggcccgcaccctcatcatgatcggctccaacgccagcgaccggatggggatgggcgtcacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatggccctcaagctgatcacgcagttcgagacctaccagctgtggaccgccctcgcctccctgatgtgcagcaacaccatcttcacgctgaccgtggcctggcgcaccgcgaccctcatcctggccgggatctccctgctccccgtctgccagagctccagcatgcggaagacggactggctgccgatgaccgtggccgccatgggcgtcccccccctgcccctcttcatcttctccctgaaggacaccctgaagcgccgcagctggccgctcaacgagggggtgatggccgtgggcctggtctccatcctggcgagctccctcctgcggaacgacgtgcccatggccggccccctggtggccgggggcctcctgatcgcctgctacgtcatcaccgggacgagcgccgacctgaccgtggagaaggcggccgacgtgacctgggaggaggaggccgagcagaccggcgtctcccacaacctcatgatcacggtggacgacgacgggaccatgcgcatcaaggacgacgagaccgagaacatcctgaccgtgctgctcaagaccgccctgctgatcgtcagcggcatcttcccctactccatcccggccacgctcctggtgtggcacacctggcagaagcagacccagcggagcggcgtgctgtgggacgtcccctccccccccgagacccagaaggcggagctcgaggagggggtgtaccgcatcaagcagcagggcatcttcgggaagacgcaggtgggcgtcggggtgcagaaggagggcgtgttccacaccatgtggcacgtcacccggggcgccgtgctgacccacaacgggaagcgcctggagccgaactgggccagcgtgaagaaggacctcatctcctacggcgggggctggcggctgagcgcccagtggcagaagggggaggaggtccaggtgatcgcggtggagcccggcaagaaccccaagaacttccagacgatgcccggcatcttccagaccaccaccggggagatcggcgccatcgccctggacttcaagccggggacgagcggctcccccatcatcaaccgcgagggcaaggtcgtggggctgtacggcaacggggtggtcaccaagagcggcgggtacgtgtccggcatcgcccagaccaacgccgagcccgacggcccgacccccgagctcgaggaggagatgttcaagaagcggaacctgacgatcatggacctgcaccccgggagcggcaagacccgcaagtacctccccgcgatcgtgcgggaggccatcaagcgccggctgcgcaccctgatcctcgccccgacccgggtcgtggccgccgagatggaggaggcgctgaaggggctgcccatccgctaccagacgaccgccaccaagtccgagcacaccggcaaggagatcgtggacctcatgtgccacgccacgttcaccatgcggctgctgagccccgtccgcgtgcccaactacaacctcatcatcatggacgaggcccacttcaccgacccggcctccatcgcggcccgggggtacatcagcacccgcgtgggcatgggcgaggccgccgcgatcttcatgacggccaccccccccgggaccgccgacgccttcccccagtccaacgccccgatccaggacgaggagcgggacatccccgagcgcagctggaactccggcaacgactggatcaccgacttcgcggggaagacggtctggttcgtgcccagcatcaaggccggcaacgacatcgccaactgcctgcgcaagaacgggaagaaggtgatccagctgtcccggaagaccttcgacaccgagtaccagaagaccaagctcaacgactgggacttcgtcgtgacgaccgacatcagcgagatgggcgccaacttcaaggccgaccgcgtgatcgacccccggcgctgcctgaagccggtcatcctgaccgacggccccgagcgggtgatcctcgcggggcccatgcccgtgaccgtcgcctccgccgcccagcgccggggccgcgtggggcggaacccgcagaaggagaacgaccagtacatcttcacgggccagcccctgaacaacgacgaggaccacgcccactggaccgaggcgaagatgctgctcgacaacatcaacacccccgaggggatcatccccgccctgttcgagccggagcgcgagaagagcgccgccatcgacggcgagtaccggctgaagggcgagtcccgcaagaccttcgtggagctcatgcggcgcggggacctgcccgtctggctggcgcacaaggtggccagcgagggcatcaagtacaccgaccggaagtggtgcttcgacggggagcgcaacaaccagatcctcgaggagaacatggacgtcgagatctggacgaaggagggcgagaagaagaagctgcggccccgctggctggacgcccggacctactccgaccccctcgccctgaaggagttcaaggacttcgccgcgggccgcaagagcatcgccttcgacctggtgaccgagatcgggcgcgtgccgagccacctcgcccaccggacccgcaacgccctggacaacctggtcatgctccacacgtccgagcacggcgggcgggcctaccgccacgcggtggaggagctgcccgagaccatggagaccctgctcctgctgggcctcatgatcctgctgaccgggggcgccatgctcttcctgatcagcggcaaggggatcggcaagacgtccatcgggctgatctgcgtggtcgccagctccggcatgctctggatggccgacatccccctgcagtggatcgccagcgcgatcgtgctggagttcttcatgatggtgctcctgatcccggagcccgagaagcagcggaccccccaggacaaccagctggcctacgtcgtgatcgggatcctcaccctggccgccatcgtggccgcgaacgagatgggcctgctcgagaccacgaagcgcgacctgggcatgtccaaggagcccggggtcgtgagcccgacctcctacctggacgtggacctccaccccgccagcgcctggaccctgtacgccgtcgcgaccacggtgatcacccccatgctgcggcacaccatcgagaactccaccgccaacgtgagcctcgccgccatcgccaaccaggcggtcgtgctgatgggcctggacaaggggtggcccatctccaagatggacctcggcgtgccgctgctggccctcgggtgctacagccaggtcaaccccctgacgctgaccgccgccgtgctcctgctggtgacccactacgccatcatcggccccggcctccaggcgaaggccacccgcgaggcccagaagcggacggccgccgggatcatgaagaaccccaccgtcgacggcatcatgaccatcgacctggacccggtgatctacgactccaagttcgagaagcagctggggcaggtgatgctcctggtcctgtgcgcggtgcagctcctgctgatgcgcaccagctgggccttctgcgaggccctcacgctggccaccggccccatcaccaccctgtgggagggctcccccgggaagttctggaacacgaccatcgcggtgagcatggccaacatcttccggggctcctacctcgccggggccggcctggccttcagcatcatgaagagcgtcgggaccggcaagcgcggcaccgggtcccagggcgagacgctgggggagaagtggaagaagaagctcaaccagctgagccggaaggagttcgacctgtacaagaagtccggcatcaccgaggtggaccgcaccgaggcgaaggaggggctcaagcggggcgagatcacccaccacgccgtgagccgcggctccgccaagctgcagtggttcgtcgagcggaacatggtgatccccgaggggcgcgtgatcgacctgggctgcgggcggggcgggtggagctactactgcgccggcctcaagaaggtcaccgaggtgcgcggctacacgaaggggggcccggggcacgaggagcccgtgcccatgtccacctacggctggaacatcgtcaagctgatgagcgggaaggacgtgttctacctgcccccggagaagtgcgacaccctcctgtgcgacatcggcgagtccagcccctcccccaccgtggaggagagccggacgatccgcgtcctgaagatggtggagccctggctgaagaacaaccagttctgcatcaaggtgctcaacccgtacatgcccaccgtcatcgagcacctggagcgcctgcagcggaagcacggcgggatgctcgtgcgcaaccccctgtcccggaacagcacccacgagatgtactggatctccaacggcaccgggaacatcgtgagctccgtcaacatggtgagccgcctgctcctgaaccggttcacgatgacctaccgccggcccaccatcgagaaggacgtggacctgggcgccggcacccgccacgtcaacgcggagccggagacgcccaacatggacgtgatcggggagcggatccgccggatcaaggaggagcactccagcacctggcactacgacgacgagaacccctacaagacctgggcctaccacggcagctacgaggtcaaggccaccgggtccgccagctccatgatcaacggcgtggtgaagctcctgacgaagccgtgggacgtcgtgcccaccgtgacccagatggccatgaccgacacgacccccttcgggcagcagcgcgtcttcaaggagaaggtggacacccggacccccaagccgatgcccggcacgcgcaaggtgatggagatcaccgcggagtggctgtggcggaccctcggccgcaacaagcggccccgcctgtgcacccgggaggagttcacgaagaaggtccgcaccaacgccgccatgggggccgtgttcaccgaggagaaccagtgggacagcgcgcgcgccgccgtggaggacgaggagttctggaagctggtcgaccgggagcgcgagctccacaagctgggcaagtgcgggtcctgcgtgtacaacatgatgggcaagcgggagaagaagctgggggagttcggcaaggccaagggcagccgcgccatctggtacatgtggctcggggcgcggtacctggagttcgaggccctgggcttcctcaacgaggaccactggttctcccgcgagaacagctactccggggtggagggcgaggggctgcacaagctgggctacatcctccgggacatcagcaagatccccggcggggccatgtacgccgacgacaccgccggctgggacacgcgcatcaccgaggacgacctgcacaacgaggagaagatcacccagcagatggacccggagcaccggcagctggcgaacgccatcttcaagctcacctaccagaacaaggtcgtgaaggtgcagcgccccacgcccaaggggaccgtcatggacatcatctcccggaaggaccagcgcggcagcggccaggtggggacctacggcctgaacaccttcaccaacatggaggcccagctgatccggcagatggagggggagggcgtgctctccaagacggacctggagaacccccacctgctcgagaagcgcatcacccagtggctggagaccaagggggtcgagcggctgaagcgcatggccatcagcggcgacgactgcgtggtgaagccgatcgacgaccggttcgccaacgcgctcctggccctgaacgacatgggcaaggtccgcaaggacatcccccagtggcagccctccaaggggtggcacgactggcagcaggtgcccttctgcagccaccacttccacgagctcatcatgaaggacggccggaagctggtggtcccgtgccgcccccaggacgagctgatcgggcgggcccgcatctcccagggcgccgggtggagcctcaaggagaccgcctgcctgggcaaggcgtacgcccagatgtgggccctgatgtacttccaccgccgggacctccgcctggcctccaacgcgatctgcagcgccgtgcccgtgcactgggtccccacgagccggaccacctggtccatccacgcccaccaccagtggatgaccacggaggacatgctgaccgtgtggaaccgcgtgtggatcgaggacaacccgtggatggaggacaagacccccgtcaccacgtgggaggacgtgccctacctcggcaagcgggaggaccagtggtgcgggagcctgatcggcctgacctcccgcgccacctgggcccagaacatcctcaccgcgatccagcaggtgcggagcctgatcgggaacgaggagttcctggactacatgccctccatgaagcgcttccggaaggaggaggagagcgagggcgccatctggtga

SEQ ID NO: 9818 - RNA, 9873 nt, synthetic construct
  misc_feature 1..9873: note = derived and/or modified CDS sequence (opt1) from DENV-3__AB214881__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcacccagacgtggatgagcgcggagggcgcctggcggcaggtggagaaggtcgagacctgggccttccgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgccggaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagcacgagaacctcaagtacacggtgatcatcaccgtccacaccggggaccagcaccaggtgggcaacgagacccagggggtcacggccgagatcaccccccaggcctccaccgtggaggccgtgctgcccgagtacggcaccctggggctcgagtgcagcccccgcaccggcctggacttcaacgagatgatcctgctcacgatgaagaacaaggcgtggatggtccaccggcagtggttcttcgacctgccgctgccctggacctccggcgccaccaccgagacgcccacctggaacaagaaggagctcctggtgaccttcaagaacgcccacgccaagaagcaggaggtggtcgtgctggggagccaggagggcgccatgcacaccgcgctcacgggggccaccgagatccagacctccggcgggaccagcatcttcgccggccacctgaagtgccgcctgaagatggacaagctcgagctgaagggcatgtcctacgccatgtgcagcaacgccttcgtgctgaagaaggaggtcagcgagacgcagcacgggaccatcctcatcaaggtggagtacaagggcgaggacgcgccctgcaagatcccgttctccaccgaggacgggcagggcaaggcccacaacggccggctgatcaccgccaaccccgtggtcacgaagaaggaggagcccgtgaacatcgaggccgagcccccgttcggggagagcaacatcatcatcggcatcggggacaaggcgctgaagatcaactggtacaagaagggctccagcatcgggaagatgttcgaggccaccgcccgcggcgcccggcgcatggccatcctgggcgacaccgcgtgggacttcgggtccgtgggcggggtcctcaacagcctgggcaagatggtgcaccagatcttcgggtccgcctacaccgccctgttcagcggcgtgtcctggatcatgaagatcggcatcggggtcctcctgacgtggatcggcctgaacagcaagaacacctccatgagcttctcctgcatcgtgatcgggatcatcaccctctacctgggcgccgtggtccaggccgacatggggtgcgtgatcaactggaagggcaaggagctgaagtgcggcagcgggatcttcgtgaccaacgaggtccacacgtggaccgagcagtacaagttccaggcggactcccccaagcggctcgccaccgccatcgccggcgcctgggagaacggggtgtgcggcatccgcagcaccacgcgcatggagaacctgctgtggaagcagatcgcgaacgagctcaactacatcctgtgggagaacaacatcaagctgaccgtggtcgtgggggacatcatcggcatcctcgagcagggcaagcggaccctgaccccccagcccatggagctgaagtactcctggaagacgtgggggaaggccaagatcgtgaccgccgagacccagaacagctccttcatcatcgacggcccgaacacccccgagtgccccagcgccagccgcgcgtggaacgtctgggaggtggaggactacgggttcggcgtgttcacgaccaacatctggctcaagctgcgggagatgtacacccagctgtgcgaccaccgcctcatgtccgccgccgtcaaggacgagcgggccgtgcacgccgacatgggctactggatcgagagccagaagaacgggtcctggaagctggagaaggcgagcctgatcgaggtgaagacctgcacctggcccaagtcccacacgctctggagcaacggcgtcctggagtccgacatgatcatcccgaagagcctggccgggcccatctcccagcacaactaccgccccggctaccacacccagaccgccgggccgtggcacctcggcaagctggagctggacttcaactactgcgagggcaccacggtggtgatcaccgagaactgcgggacccggggccccagcctccgcaccacgaccgtctccgggaagctgatccacgagtggtgctgccggagctgcaccctgccccccctccgctacatgggcgaggacgggtgctggtacggcatggagatccggccgatcaacgagaaggaggagaacatggtgaagtccctggtgagcgccggctccgggaaggtcgacaacttcaccatgggcgtgctgtgcctcgccatcctgttcgaggaggtgatgcgcgggaagttcggcaagaagcacatgatcgcgggggtcctgttcacgttcgtgctcctgctgagcggccagatcacctggcgggacatggcccgcaccctcatcatgatcggctccaacgccagcgaccggatggggatgggcgtgacctacctggccctgatcgccacgttcaagatccagcccttcctcgcgctggggttcttcctgcgcaagctcaccagccgggagaacctgctgctcggcgtcggcctggccatggccaccaccctgcagctccccgaggacatcgagcagatggccaacgggatcgcgctgggcctgatggccctcaagctgatcacgcagttcgagacctaccagctgtggaccgccctcgcctccctgatgtgcagcaacaccatcttcacgctgaccgtggcctggcgcaccgcgaccctcatcctggccgggatctccctgctccccgtgtgccagagctccagcatgcggaagacggactggctgccgatgaccgtcgccgccatgggcgtgccccccctgcccctcttcatcttctccctgaaggacaccctgaagcgccgcagctggccgctcaacgagggggtcatggccgtgggcctggtgtccatcctggcgagctccctcctgcggaacgacgtccccatggccggccccctggtggccgggggcctcctgatcgcctgctacgtgatcaccgggacgagcgccgacctgaccgtcgagaaggcggccgacgtgacctgggaggaggaggccgagcagaccggcgtgtcccacaacctcatgatcacggtcgacgacgacgggaccatgcgcatcaaggacgacgagaccgagaacatcctgaccgtgctgctcaagaccgccctgctgatcgtgagcggcatcttcccctactccatcccggccacgctcctggtctggcacacctggcagaagcagacccagcggagcggcgtgctgtgggacgtgccctccccccccgagacccagaaggcggagctcgaggagggggtctaccgcatcaagcagcagggcatcttcgggaagacgcaggtgggcgtgggggtccagaaggagggcgtgttccacaccatgtggcacgtgacccggggcgccgtcctgacccacaacgggaagcgcctggagccgaactgggccagcgtgaagaaggacctcatctcctacggcgggggctggcggctgagcgcccagtggcagaagggggaggaggtgcaggtcatcgcggtggagcccggcaagaaccccaagaacttccagacgatgcccggcatcttccagaccaccaccggggagatcggcgccatcgccctggacttcaagccggggacgagcggctcccccatcatcaaccgcgagggcaaggtggtcgggctgtacggcaacggggtggtgaccaagagcggcgggtacgtctccggcatcgcccagaccaacgccgagcccgacggcccgacccccgagctcgaggaggagatgttcaagaagcggaacctgacgatcatggacctgcaccccgggagcggcaagacccgcaagtacctccccgcgatcgtgcgggaggccatcaagcgccggctgcgcaccctgatcctcgccccgacccgggtggtcgccgccgagatggaggaggcgctgaaggggctgcccatccgctaccagacgaccgccaccaagtccgagcacaccggcaaggagatcgtggacctcatgtgccacgccacgttcaccatgcggctgctgagccccgtgcgcgtccccaactacaacctcatcatcatggacgaggcccacttcaccgacccggcctccatcgcggcccgggggtacatcagcacccgcgtgggcatgggcgaggccgccgcgatcttcatgacggccaccccccccgggaccgccgacgccttcccccagtccaacgccccgatccaggacgaggagcgggacatccccgagcgcagctggaactccggcaacgactggatcaccgacttcgcggggaagacggtgtggttcgtccccagcatcaaggccggcaacgacatcgccaactgcctgcgcaagaacgggaagaaggtgatccagctgtcccggaagaccttcgacaccgagtaccagaagaccaagctcaacgactgggacttcgtggtcacgaccgacatcagcgagatgggcgccaacttcaaggccgaccgcgtgatcgacccccggcgctgcctgaagccggtgatcctgaccgacggccccgagcgggtcatcctcgcggggcccatgcccgtgaccgtggcctccgccgcccagcgccggggccgcgtcgggcggaacccgcagaaggagaacgaccagtacatcttcacgggccagcccctgaacaacgacgaggaccacgcccactggaccgaggcgaagatgctgctcgacaacatcaacacccccgaggggatcatccccgccctgttcgagccggagcgcgagaagagcgccgccatcgacggcgagtaccggctgaagggcgagtcccgcaagaccttcgtggagctcatgcggcgcggggacctgcccgtgtggctggcgcacaaggtcgccagcgagggcatcaagtacaccgaccggaagtggtgcttcgacggggagcgcaacaaccagatcctcgaggagaacatggacgtggagatctggacgaaggagggcgagaagaagaagctgcggccccgctggctggacgcccggacctactccgaccccctcgccctgaaggagttcaaggacttcgccgcgggccgcaagagcatcgccttcgacctggtcaccgagatcgggcgcgtgccgagccacctcgcccaccggacccgcaacgccctggacaacctggtgatgctccacacgtccgagcacggcgggcgggcctaccgccacgcggtcgaggagctgcccgagaccatggagaccctgctcctgctgggcctcatgatcctgctgaccgggggcgccatgctcttcctgatcagcggcaaggggatcggcaagacgtccatcgggctgatctgcgtggtggccagctccggcatgctctggatggccgacatccccctgcagtggatcgccagcgcgatcgtcctggagttcttcatgatggtgctcctgatcccggagcccgagaagcagcggaccccccaggacaaccagctggcctacgtggtcatcgggatcctcaccctggccgccatcgtggccgcgaacgagatgggcctgctcgagaccacgaagcgcgacctgggcatgtccaaggagcccggggtggtcagcccgacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggcccatctccaagatggacctcggcgtgccgctgctggccctcgggtgctacagccaggtgaaccccctgacgctgaccgccgccgtcctcctgctggtgacccactacgccatcatcggccccggcctccaggcgaaggccacccgcgaggcccagaagcggacggccgccgggatcatgaagaaccccaccgtggacggcatcatgaccatcgacctggacccggtcatctacgactccaagttcgagaagcagctggggcaggtgatgctcctggtgctgtgcgcggtccagctcctgctgatgcgcaccagctgggccttctgcgaggccctcacgctggccaccggccccatcaccaccctgtgggagggctcccccgggaagttctggaacacgaccatcgcggtgagcatggccaacatcttccggggctcctacctcgccggggccggcctggccttcagcatcatgaagagcgtggggaccggcaagcgcggcaccgggtcccagggcgagacgctgggggagaagtggaagaagaagctcaaccagctgagccggaaggagttcgacctgtacaagaagtccggcatcaccgaggtcgaccgcaccgaggcgaaggaggggctcaagcggggcgagatcacccaccacgccgtgagccgcggctccgccaagctgcagtggttcgtggagcggaacatggtcatccccgaggggcgcgtgatcgacctgggctgcgggcggggcgggtggagctactactgcgccggcctcaagaaggtgaccgaggtccgcggctacacgaaggggggcccggggcacgaggagcccgtgcccatgtccacctacggctggaacatcgtgaagctgatgagcgggaaggacgtcttctacctgcccccggagaagtgcgacaccctcctgtgcgacatcggcgagtccagcccctcccccaccgtggaggagagccggacgatccgcgtgctgaagatggtcgagccctggctgaagaacaaccagttctgcatcaaggtgctcaacccgtacatgcccaccgtgatcgagcacctggagcgcctgcagcggaagcacggcgggatgctcgtccgcaaccccctgtcccggaacagcacccacgagatgtactggatctccaacggcaccgggaacatcgtgagctccgtgaacatggtcagccgcctgctcctgaaccggttcacgatgacctaccgccggcccaccatcgagaaggacgtggacctgggcgccggcacccgccacgtgaacgcggagccggagacgcccaacatggacgtcatcggggagcggatccgccggatcaaggaggagcactccagcacctggcactacgacgacgagaacccctacaagacctgggcctaccacggcagctacgaggtgaaggccaccgggtccgccagctccatgatcaacggcgtcgtgaagctcctgacgaagccgtgggacgtggtccccaccgtgacccagatggccatgaccgacacgacccccttcgggcagcagcgcgtgttcaaggagaaggtcgacacccggacccccaagccgatgcccggcacgcgcaaggtgatggagatcaccgcggagtggctgtggcggaccctcggccgcaacaagcggccccgcctgtgcacccgggaggagttcacgaagaaggtgcgcaccaacgccgccatgggggccgtcttcaccgaggagaaccagtgggacagcgcgcgcgccgccgtggaggacgaggagttctggaagctggtggaccgggagcgcgagctccacaagctgggcaagtgcgggtcctgcgtctacaacatgatgggcaagcgggagaagaagctgggggagttcggcaaggccaagggcagccgcgccatctggtacatgtggctcggggcgcggtacctggagttcgaggccctgggcttcctcaacgaggaccactggttctcccgcgagaacagctactccggggtggagggcgaggggctgcacaagctgggctacatcctccgggacatcagcaagatccccggcggggccatgtacgccgacgacaccgccggctgggacacgcgcatcaccgaggacgacctgcacaacgaggagaagatcacccagcagatggacccggagcaccggcagctggcgaacgccatcttcaagctcacctaccagaacaaggtggtcaaggtgcagcgccccacgcccaaggggaccgtgatggacatcatctcccggaaggaccagcgcggcagcggccaggtcgggacctacggcctgaacaccttcaccaacatggaggcccagctgatccggcagatggagggggagggcgtgctctccaagacggacctggagaacccccacctgctcgagaagcgcatcacccagtggctggagaccaagggggtggagcggctgaagcgcatggccatcagcggcgacgactgcgtcgtgaagccgatcgacgaccggttcgccaacgcgctcctggccctgaacgacatgggcaaggtgcgcaaggacatcccccagtggcagccctccaaggggtggcacgactggcagcaggtccccttctgcagccaccacttccacgagctcatcatgaaggacggccggaagctggtggtgccgtgccgcccccaggacgagctgatcgggcgggcccgcatctcccagggcgccgggtggagcctcaaggagaccgcctgcctgggcaaggcgtacgcccagatgtgggccctgatgtacttccaccgccgggacctccgcctggcctccaacgcgatctgcagcgccgtccccgtgcactgggtgcccacgagccggaccacctggtccatccacgcccaccaccagtggatgaccacggaggacatgctgaccgtctggaaccgcgtgtggatcgaggacaacccgtggatggaggacaagacccccgtgaccacgtgggaggacgtcccctacctcggcaagcgggaggaccagtggtgcgggagcctgatcggcctgacctcccgcgccacctgggcccagaacatcctcaccgcgatccagcaggtgcggagcctgatcgggaacgaggagttcctggactacatgccctccatgaagcgcttccggaaggaggaggagctcgagggcgccatctggtga

SEQ ID NO: 9819 - RNA, 9873 nt, synthetic construct
  misc_feature 1..9873: note = derived and/or modified CDS sequence (opt1) from DENV-3__AB214882__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggcgccccacgtgggcatggggctggacacccgcacccagacgtggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagcacgagaacctcaagtacacggtgatcatcaccgtccacaccggggaccagcaccaggtgggcaacgagacccagggggtcacggccgagatcacgccccaggcctccaccgtggaggccgtgctgcccgagtacggcaccctggggctcgagtgcagcccccgcaccggcctggacttcaacgagatgatcctgctcacgatgaagaacaaggcgtggatggtccaccggcagtggttcttcgacctgccgctgccctggacctccggcgccaccaccgagacgcccacctggaacaagaaggagctcctggtgaccttcaagaacgcccacgccaagaagcaggaggtggtcgtgctggggagccaggagggcgccatgcacaccgcgctcacgggggccaccgagatccagacctccggcgggaccagcatcttcgccggccacctgaagtgccgcctgaagatggacaagctcgagctgaagggcatgtcctacgccatgtgcagcaacgccttcgtgctgaagaaggaggtcagcgagacgcagcacgggaccatcctcatcaaggtggagtacaagggcgaggacgcgccctgcaagatcccgttctccaccgaggacgggcagggcaaggcccacaacggccggctgatcaccgccaaccccgtggtcacgaagaaggaggagcccgtgaacatcgaggccgagcccccgttcggggagagcaacatcatcatcggcatcggggacaaggcgctgaagatcaactggtacaagaagggctccagcatcgggaagatgttcgaggccaccgcccgcggcgcccggcgcatggccatcctgggcgacaccgcgtgggacttcgggtccgtgggcggggtcctcaacagcctgggcaagatggtgcaccagatcttcgggtccgcctacaccgccctgttcagcggcgtgtcctggatcatgaagatcggcatcggggtcctcctgacgtggatcggcctgaacagcaagaacacctccatgagcttctcctgcatcgtgatcgggatcatcaccctctacctgggcgccgtggtccaggccgacatggggtgcgtgatcaactggaagggcaaggagctgaagtgcggcagcgggatcttcgtgaccaacgaggtccacacgtggaccgagcagtacaagttccaggcggactcccccaagcggctcgccaccgccatcgccggcgcctgggagaacggggtgtgcggcatccgcagcaccacgcgcatggagaacctgctgtggaagcagatcgcgaacgagctcaactacatcctgtgggagaacaacatcaagctgaccgtggtcgtgggggacatcaccggcatcctcgagcagggcaagcggaccctgacgccccagcccatggagctgaagtactcctggaagacctgggggaaggccaagatcgtgaccgccgagacccagaacagctccttcatcatcgacggcccgaacacgcccgagtgccccagcgccagccgcgcgtggaacgtctgggaggtggaggactacgggttcggcgtgttcaccaccaacatctggctcaagctgcgggagatgtacacccagctgtgcgaccaccgcctcatgtccgccgccgtcaaggacgagcgggccgtgcacgccgacatgggctactggatcgagagccagaagaacgggtcctggaagctggagaaggcgagcctgatcgaggtgaagacctgcacgtggcccaagtcccacaccctctggagcaacggcgtcctggagtccgacatgatcatccccaagagcctggccgggcccatctcccagcacaactaccgccccggctaccacacccagaccgccgggccgtggcacctcggcaagctggagctggacttcaactactgcgagggcacgaccgtggtgatcaccgagaactgcgggacccggggccccagcctccgcacgaccaccgtctccgggaagctgatccacgagtggtgctgccggagctgcaccctgccgcccctgcgctacatgggcgaggacgggtgctggtacggcatggagatccggccgatcaacgagaaggaggagaacatggtgaagtccctggtgagcgccggctccgggaaggtcgacaacttcacgatgggcgtgctgtgcctcgccatcctgttcgaggaggtgatgcgcgggaagttcggcaagaagcacatgatcgcgggggtcctgttcaccttcgtgctcctgctgagcggccagatcacctggcgggacatggcccgcaccctcatcatgatcggctccaacgccagcgaccggatggggatgggcgtgacgtacctggccctgatcgccaccttcaagatccagcccttcctcgcgctggggttcttcctgcgcaagctcaccagccgggagaacctgctgctcggcgtcggcctggccatggccaccacgctgcagctccccgaggacatcgagcagatggccaacgggatcgcgctgggcctgatggccctcaagctgatcacccagttcgagacctaccagctgtggaccgccctcgcctccctgatgtgcagcaacacgatcttcaccctgaccgtggcctggcgcaccgcgacgctcatcctggccgggatctccctgctccccgtgtgccagagctccagcatgcggaagaccgactggctgccgatgaccgtcgccgccatgggcgtgccgcccctccccctcttcatcttctccctgaaggacaccctgaagcgccgcagctggccgctcaacgagggggtcatggccgtgggcctggtgtccatcctggcgagctccctcctgcggaacgacgtccccatggccggccccctggtggccgggggcctcctgatcgcctgctacgtgatcacggggaccagcgccgacctgaccgtcgagaaggcggccgacgtgacctgggaggaggaggccgagcagacgggcgtgtcccacaacctcatgatcaccgtcgacgacgacgggaccatgcgcatcaaggacgacgagaccgagaacatcctgaccgtgctgctcaagacggccctgctgatcgtgagcggcatcttcccctactccatcccggccaccctcctggtctggcacacctggcagaagcagacccagcggagcggcgtgctgtgggacgtgcccagcccgcccgagacgcagaaggcggagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagccgaactgggccagcgtgaagaaggacctcatctcctacggcgggggctggcggctgagcgcccagtggcagaagggggaggaggtgcaggtcatcgcggtggagcccggcaagaaccccaagaacttccagaccatgcccggcatcttccagaccaccacgggggagatcggcgccatcgccctggacttcaagccggggaccagcggctcccccatcatcaaccgcgagggcaaggtggtcgggctgtacggcaacggggtggtgaccaagagcggcgggtacgtctccggcatcgcccagaccaacgccgagcccgacggcccgacgcccgagctcgaggaggagatgttcaagaagcggaacctgaccatcatggacctgcaccccgggagcggcaagacccgcaagtacctccccgcgatcgtgcgggaggccatcaagcgccggctgcgcaccctgatcctcgccccgacgcgggtggtcgccgccgagatggaggaggcgctgaaggggctgcccatccgctaccagaccaccgccaccaagtccgagcacacgggcaaggagatcgtggacctcatgtgccacgccaccttcaccatgcggctgctgagccccgtgcgcgtccccaactacaacctcatcatcatggacgaggcccacttcaccgacccggcctccatcgcggcccgggggtacatcagcacgcgcgtgggcatgggcgaggccgccgcgatcttcatgaccgccacgccgcccgggaccgccgacgccttcccccagtccaacgccccgatccaggacgaggagcgggacatccccgagcgcagctggaactccggcaacgactggatcacggacttcgcggggaagaccgtgtggttcgtccccagcatcaaggccggcaacgacatcgccaactgcctgcgcaagaacgggaagaaggtgatccagctgtcccggaagaccttcgacaccgagtaccagaagacgaagctcaacgactgggacttcgtggtcaccaccgacatcagcgagatgggcgccaacttcaaggccgaccgcgtgatcgacccccggcgctgcctgaagccggtgatcctgaccgacggccccgagcgggtcatcctcgcggggcccatgcccgtgacggtggcctccgccgcccagcgccggggccgcgtcgggcggaacccgcagaaggagaacgaccagtacatcttcaccggccagcccctgaacaacgacgaggaccacgcccactggaccgaggcgaagatgctgctcgacaacatcaacacccccgaggggatcatccccgccctgttcgagccggagcgcgagaagtccgccgccatcgacggcgagtaccggctgaagggcgagtcccgcaagaccttcgtggagctcatgcggcgcggggacctgcccgtgtggctggcgcacaaggtcgccagcgagggcatcaagtacacggaccggaagtggtgcttcgacggggagcgcaacaaccagatcctcgaggagaacatggacgtggagatctggaccaaggagggcgagaagaagaagctgcggccccgctggctggacgcccggacctactccgaccccctcgccctgaaggagttcaaggacttcgccgcgggccgcaagagcatcgccttcgacctggtcaccgagatcgggcgcgtgccgagccacctcgcccaccggacgcgcaacgccctggacaacctggtgatgctccacacctccgagcacggcgggcgggcctaccgccacgcggtcgaggagctgcccgagaccatggagaccctgctcctgctgggcctcatgatcctgctgaccggcggggccatgctgttcctgatcagcgggaaggggatcggcaagacctccatcgggctgatctgcgtggtggccagctccggcatgctctggatggccgacatccccctgcagtggatcgccagcgcgatcgtcctggagttcttcatgatggtgctcctgatcccggagcccgagaagcagcggacgccccaggacaaccagctggcctacgtggtcatcgggatcctcaccctggccgccatcgtggccgcgaacgagatgggcctgctcgagacgaccaagcgcgacctgggcatgtccaaggagcccggggtggtcagcccgacctcctacctggacgtggacctccaccccgccagcgcctggaccctgtacgccgtggcgacgaccgtcatcacccccatgctgcggcacaccatcgagaactccacggccaacgtgagcctcgccgccatcgccaaccaggcggtggtcctgatgggcctggacaaggggtggcccatctccaagatggacctcggcgtgccgctgctggccctcgggtgctacagccaggtgaaccccctgaccctgaccgccgccgtcctcctgctggtgacccactacgccatcatcggccccggcctccaggcgaaggccacgcgcgaggcccagaagcggaccgccgccgggatcatgaagaaccccaccgtggacggcatcatgaccatcgacctggacccggtcatctacgactccaagttcgagaagcagctgggccaggtgatgctcctggtgctgtgcgcggtccagctcctgctgatgcgcacgagctgggccttctgcgaggccctcaccctggccaccggccccatcaccacgctgtgggagggctcccccgggaagttctggaacaccaccatcgcggtgagcatggccaacatcttccggggctcctacctcgccggggccggcctggccttcagcatcatgaagtccgtggggaccggcaagcgcggcacggggtcccagggcgagaccctgggggagaagtggaagaagaagctcaaccagctgagccggaaggagttcgacctgtacaagaagtccggcatcaccgaggtcgaccgcaccgaggcgaaggaggggctcaagcggggcgagatcacccaccacgccgtgagccgcggctccgccaagctgcagtggttcgtggagcggaacatggtcatccccgaggggcgcgtgatcgacctgggctgcgggcggggcgggtggagctactactgcgccggcctcaagaaggtgacggaggtccgcggctacaccaagggcgggccggggcacgaggagcccgtgcccatgtccacctacggctggaacatcgtgaagctgatgagcgggaaggacgtcttctacctgcccccggagaagtgcgacaccctcctgtgcgacatcggcgagtccagcccctcccccacggtggaggagagccggaccatccgcgtgctgaagatggtcgagccctggctgaagaacaaccagttctgcatcaaggtgctcaacccgtacatgcccaccgtgatcgagcacctggagcgcctgcagcggaagcacggcgggatgctcgtccgcaaccccctgtcccggaacagcacccacgagatgtactggatctccaacggcacggggaacatcgtgagctccgtgaacatggtcagccgcctgctcctgaaccggttcaccatgacctaccgccggcccaccatcgagaaggacgtggacctgggcgccggcacgcgccacgtgaacgcggagccggagacccccaacatggacgtcatcggggagcggatccgccggatcaaggaggagcactccagcacctggcactacgacgacgagaacccctacaagacctgggcctaccacggcagctacgaggtgaaggccacggggtccgccagctccatgatcaacggcgtcgtgaagctcctgaccaagccgtgggacgtggtccccaccgtgacccagatggccatgacggacaccacccccttcgggcagcagcgcgtgttcaaggagaaggtcgacacccggacgcccaagccgatgcccggcacccgcaaggtgatggagatcaccgcggagtggctgtggcggaccctcggccgcaacaagcggccccgcctgtgcacgcgggaggagttcaccaagaaggtgcgcaccaacgccgccatgggggccgtcttcaccgaggagaaccagtgggacagcgcgcgcgccgccgtggaggacgaggagttctggaagctggtggaccgggagcgcgagctccacaagctgggcaagtgcgggtcctgcgtctacaacatgatgggcaagcgggagaagaagctgggggagttcggcaaggccaagggcagccgcgccatctggtacatgtggctcggggcgcggtacctggagttcgaggccctgggcttcctcaacgaggaccactggttctcccgcgagaacagctactccggggtggagggcgaggggctgcacaagctgggctacatcctccgggacatcagcaagatccccggcggggccatgtacgccgacgacacggccggctgggacacccgcatcaccgaggacgacctgcacaacgaggagaagatcacccagcagatggacccggagcaccggcagctggcgaacgccatcttcaagctcacgtaccagaacaaggtggtcaaggtgcagcgccccacccccaaggggaccgtgatggacatcatctcccggaaggaccagcgcggcagcggccaggtcgggacctacggcctgaacaccttcacgaacatggaggcccagctgatccggcagatggagggggagggcgtgctctccaagaccgacctggagaacccccacctcctcgagaagcgcatcacccagtggctggagaccaagggggtggagcggctgaagcgcatggccatcagcggcgacgactgcgtcgtgaagccgatcgacgaccggttcgccaacgcgctcctggccctgaacgacatgggcaaggtgcgcaaggacatcccccagtggcagccctccaaggggtggcacgactggcagcaggtccccttctgcagccaccacttccacgagctcatcatgaaggacggccggaagctggtggtgccgtgccgcccccaggacgagctgatcgggcgggcccgcatctcccagggcgccgggtggagcctcaaggagacggcctgcctgggcaaggcgtacgcccagatgtgggccctgatgtacttccaccgccgggacctccgcctggcctccaacgcgatctgcagcgccgtccccgtgcactgggtgcccaccagccggaccacctggtccatccacgcccaccaccagtggatgacgaccgaggacatgctgaccgtctggaaccgcgtgtggatcgaggacaacccgtggatggaggacaagacccccgtgacgacctgggaggacgtcccctacctcggcaagcgggaggaccagtggtgcgggagcctgatcggcctgacctcccgcgccacctgggcccagaacatcctcacggcgatccagcaggtccggagcctgatcgggaacgaggagttcctggactacatgccctccatgaagcgcttccggaaggaggaggagagcgagggcgccatctggtga

SEQ ID NO: 9820 - RNA, 9873 nt, synthetic construct
  misc_feature 1..9873: note = derived and/or modified CDS sequence (opt1) from DENV-3__JX669489__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtaccggggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgctgttcaccttcgtgctcctgctgtccggccagatcacctggcgcgacatggcccacaccctcatcatgatcggcagcaacgcctccgaccggatggggatgggcgtcacgtacctggccctgatcgcgaccttcaagatccagcccttcctcgccctggggttcttcctgcgcaagctcaccagccgggagaacctgctgctcggcgtgggcctggccatggccaccacgctgcagctccccgaggacatcgagcagatcgcgaacgggatcgccctgggcctgatggccctcaagctgatcacccagttcgagacctaccagctgtggaccgccctcatcagcctgacgtgctccaacaccatgttcaccctgaccgtggcctggcgcacggcgaccctcatcctggccggggtcagcctgctcccggtgtgccagtccagctccatgcgcaagaccgactggctgcccatggccgtcgccgccatgggcgtgccgcccctgcccctgttcatcttcagcctgaaggacaccctgaagcggcgctcctggcccctcaacgagggggtgatggcggtcggcctggtgagcatcctggcctccagcctcctgcggaacgacgtgcccatggccggccccctggtcgccgggggcctcctgatcgcctgctacgtgatcacggggacctccgcggacctgaccgtggagaaggccgccgacatcacctgggaggaggaggccgagcagacgggcgtcagccacaacctcatgatcaccgtggacgacgacgggaccatgcgcatcaaggacgacgagaccgagaacatcctgaccgtgctgctcaagacggccctgctgatcgtctccggcgtgttcccgtacagcatccccgcgaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgtacaacgggaagcgcctggagcccaactgggcctccgtcaagaaggacctcatcagctacggcgggggctggcggctgtccgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgcggagccggacggccccacccccgagctcgaggaggagatgttcaagaagcggaacctgaccatcatggacctgcaccccgggagcggcaagacccgcaagtacctcccggccatcgtccgggaggccatcaagcgccggctgcgcacgctgatcctcgcccccacccgggtggtggccgcggagatggaggaggccctgaaggggctgcccatccgctaccagaccaccgccacgaagtccgagcacaccggccgggagatcgtcgacctcatgtgccacgccaccttcaccatgcgcctgctgagccccgtgcgggtgccgaactacaacctcatcatcatggacgaggcccacttcacggaccccgcgtccatcgccgcccgcgggtacatcagcacccgcgtcggcatgggcgaggccgcggccatcttcatgaccgccacgccgcccgggacggccgacgccttcccgcagtccaacgcgcccatccaggacgaggagcgggacatccccgagcgcagctggaactccggcaacgagtggatcaccgacttcgccgggaagaccgtgtggttcgtgcccagcatcaaggccggcaacgacatcgccaactgcctgcggaagaacgggaagaaggtcatccagctgtcccgcaagaccttcgacacggagtaccagaagaccaagctcaacgactgggacttcgtggtgaccaccgacatcagcgagatgggcgccaacttcaaggcggaccgggtcatcgacccgcgccggtgcctgaagcccgtgatcctgacggacggccccgagcgcgtgatcctcgccgggcccatgccggtcaccgccgcctccgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacacccccgaggggatcatcccggccctgttcgagcccgagcgggagaagtccgcggccatcgacggcgagtaccgcctgaagggcgagtcccggaagacgttcgtggagctcatgcgccgcggggacctgcccgtctggctggcccacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccgctggctggacgcccggacctactccgacccgctcgcgctgaaggagttcaaggacttcgccgccggccgcaagagcatcgccctggacctcgtgacggagatcgggcgggtgccctcccacctggcccaccgcacccggaacgcgctggacaacctcgtcatgctgcacaccagcgagcacggcgggcgcgcctaccggcacgccgtggaggagctgcccgagaccatggagacgctcctgctgctcggcctgatgatcctgctcaccgggggcgccatgctgttcctgatcagcggcaaggggatcggcaagacctccatcgggctcatctgcgtgatcgccagctccggcatgctgtggatggcggagatcccgctgcagtggatcgccagcgccatcgtcctcgagttcttcatgatggtgctgctgatccccgagcccgagaagcagcgcacgccccaggacaaccagctcgcctacgtggtcatcgggatcctgacgctggccgcgatcatcgccgccaacgagatgggcctcctggagaccaccaagcgggacctgggcatgtccaaggagccgggggtggtgagccccacctcctacctcgacgtcgacctgcaccccgccagcgcgtggacgctgtacgccgtggccaccaccgtgatcacccccatgctccgccacacgatcgagaactccaccgccaacgtcagcctggccgcgatcgccaaccaggccgtggtgctgatgggcctcgacaaggggtggccgatctccaagatggacctgggcgtccccctgctcgccctggggtgctacagccaggtgaaccccctgaccctcaccgccgcggtgctgctgctcatcacgcactacgccatcatcggccccggcctgcaggccaaggccacccgggaggcccagaagcgcaccgcggccgggatcatgaagaacccgaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggcgctgaccctcgccaccggccccatcacgaccctgtgggagggctcccccgggaagttctggaacaccaccatcgccgtgagcatggccaacatcttccgcggctcctacctggccggggcgggcctcgccttcagcatcatgaagtccgtcgggacgggcaagcggggcaccgggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagatcacgcaccacgccgtgagccggggctccgccaagctccagtggttcgtcgagcgcaacatggtgatcccggaggggcgggtgatcgacctgggctgcgggcgcggcgggtggagctactactgcgcgggcctgaagaaggtcaccgaggtgcgcggctacaccaagggcgggcccgggcacgaggagcccgtgcccatgtccacctacggctggaacatcgtcaagctcatgagcgggaaggacgtgttctacctgccgcccgagaagtgcgacacgctgctgtgcgacatcggcgagtccagcccctcccccaccgtggaggagagccggaccatccgcgtcctcaagatggtggagccgtggctgaagaacaaccagttctgcatcaaggtgctgaacccctacatgcccaccgtcatcgagcacctcgagcggctgcagcgcaagcacggcgggatgctggtgcggaaccccctctcccgcaacagcacgcacgagatgtactggatctccaacggcaccgggaacatcgtggccagcgtcaacatggtgtcccggctgctgctcaaccgcttcaccatgacccaccggcgcccgacgatcgagaaggacgtggacctgggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctcaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgccgagtggctgtggcggaccctggggcgcaacaagaagccccgcctctgcacgcgggaggagttcaccaagaaggtccgcaccaacgcggccatgggcgccgtgttcaccgaggagaaccagtgggactccgccaaggccgcggtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgccatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgcgatgtacgccgacgacacggccgggtgggacacccgcatcaccgaggacgacctccacaacgaggagaagatcacccagcagatggacccggagcaccggcagctggccaacgccatcttcaagctgacgtaccagaacaaggtcgtgaaggtgcagcgccccacccccaccggcaccgtcatggacatcatcagccggaaggaccagcgcggctccggccaggtgggcacctacgggctcaacacgttcaccaacatggaggcgcagctgatccggcagatggagggcgagggggtgctgagcaaggccgacctcgagaacccccacctcccggagaagaagatcacccagtggctggagaccaagggcgtcgagcgcctcaagcggatggccatctccggcgacgactgcgtggtgaagcccatcgacgaccgcttcgccaacgccctgctggcgctcaacgacatggggaaggtccggaaggacatcccccagtggcagcccagcaagggctggcacgactggcagcaggtcccgttctgctcccaccacttccacgagctgatcatgaaggacgggcgcaagctggtggtcccctgccggccccaggacgagctcatcggccgcgcccgcatcagccagggggccggctggtccctgcgggagacggcctgcctgggcaaggcgtacgcccagatgtggagcctcatgtacttccaccgccgggacctgcgcctggcctccaacgccatctgcagcgccgtgcccgtgcactgggtcccgacctcccggaccacctggagcatccacgcgcaccaccagtggatgacgaccgaggacatgctcaccgtgtggaaccgcgtgtggatcgaggacaacccctggatggaggacaagacccccgtcacgacctgggagaacgtgccctacctggggaagcgggaggaccagtggtgcggcagcctgatcgggctcacctcccgcgccacctgggcccagaacatcccgacggccatccagcaggtccggagcctgatcggcaacgaggagttcctggactacatgccctccatgaagcgcttccggaaggaggaggagagcgagggggccatctggtga

SEQ ID NO: 9821 - RNA, 9873 nt, synthetic construct
  misc_feature 1..9873: note = derived and/or modified CDS sequence (opt1) from DENV-3__JX669498__SS-prME
  source 1..9873: mol_type = other RNA
accagcctctgcctcatgatgatcctgcccgccgccctggcgttccacctcacctcccgcgacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcaccccgggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgcccgaggagcaggaccagaactacgtctgcaagcacacctacgtggaccgcgggtggggcaacgggtgcggcctcttcgggaagggctccctggtgacctgcgccaagttccagtgcctggagagcatcgagggcaaggtcgtgcagtacgagaacctcaagtacaccgtgatcatcacggtccacaccggggaccagcaccaggtgggcaacgagacccagggggtcaccgccgagatcacgccccaggcctccaccaccgaggcgatcctgcccgagtacggcaccctggggctcgagtgcagcccccggaccggcctggacttcaacgagatgatcctgctcacgatgaagaacaaggcctggatggtgcaccgccagtggttcttcgacctgccgctgccctggacctccggcgccaccaccgagacgcccacctggaaccggaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccgcctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgcgccctgcaagatcccgttcagcaccgaggacgggcagggcaaggcccacaacggccggctgatcacggccaaccccgtcgtgaccaagaaggaggagcccgtgaacatcgaggccgagcccccgttcggggagtccaacatcgtcatcggcaccggggacaacgcgctgaagatcaactggtacaagaagggcagctccatcgggaagatgttcgaggccaccgcccgcggcgcccggcgcatggccatcctgggcgacacggcgtgggacttcgggagcgtgggcggggtgctcaactccctgggcaagatggtccaccagatcttcgggagcgcctacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcggacatggggtgcgtcatcaactggaagggcaaggagctgaagtgcggctccgggatcttcgtgaccaacgaggtgcacacctggaccgagcagtacaagttccaggccgacagccccaagcgcctcgccacggccatcgccggcgcgtgggagaacggggtctgcggcatccggtccaccacccgcatggagaacctgctgtggaagcagatcgccaacgagctcaactacatcctgtgggagaacaacatcaagctgaccgtggtggtcggggacatcatcggcgtgctcgagcagggcaagcggacgctgacgccccagcccatggagctgaagtacagctggaagacctgggggaaggccaagatcgtgaccgccgagacgcagaactccagcttcatcatcgacggcccgaacacccccgagtgcccctccgcgagccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatcgagtcccagaagaacgggagctggaagctggagaaggcctccctgatcgaggtcaagacgtgcacctggcccaagagccacaccctctggtccaacggcgtgctggagagcgacatgatcatcccgaagtccctggccgggcccatcagccagcacaaccaccgccccggctaccacacccagacggccgggccgtggcacctcggcaagctggagctggacttcaactactgcgagggcaccaccgtggtcatcaccgagaactgcgggacgcggggcccctccctccgcaccaccaccgtgagcgggaagctgatccacgagtggtgctgccggtcctgcacgctgccgcccctccgctacatgggcgaggacgggtgctggtacggcatggagatccggccgatcagcgagaaggaggagaacatggtgaagtccctggtcagcgccggctccgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgagcggccagatcacctggcgggacatggcccacacgctgatcatgatcggctccaacgccagcgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatctccctgacctgcagcaacaccatgttcaccctgacggtggcctggcggaccgcgaccctgatcctcgccggggtctccctgctgcccgtgtgccagagctccagcatgcgcaagaccgactggctcccgatggccgtcgccgccatgggcgtgccgcccctccccctgttcatcttctccctcaaggacacgctgaagcgccggagctggccgctgaacgagggggtgatggcggtcggcctcgtgtccatcctggccagctccctgctccgcaacgacgtgcccatggccggccccctggtcgccgggggcctgctcatcgcctgctacgtgatcaccgggaccagcgcggacctgaccgtggagaaggccgccgacatcacgtgggaggaggaggccgagcagaccggcgtctcccacaacctgatgatcaccgtggacgacgacgggaccatgcggatcaaggacgacgagaccgagaacatcctcacggtgctgctgaagaccgccctcctgatcgtcagcggcgtgttcccctactccatcccggcgaccctgctcgtgtggcacacctggcagaagcagacgcagcgcagcggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagccgaactgggccagcgtcaagaaggacctgatctcctacggcgggggctggcgcctcagcgcgcagtggcagaagggggaggaggtccaggtgatcgccgtcgagcccggcaagaaccccaagaacttccagaccatgcccggcaccttccagacgaccaccggggagatcggcgccatcgccctggacttcaagccggggaccagcggctcccccatcatcaaccgggagggcaaggtggtggggctgtacggcaacggggtcgtgacgaagaacggcgggtacgtgagcggcatcgcccagaccaacgcggagcccgacggcccgacccccgagctggaggaggagatgttcaagaagcgcaacctcaccatcatggacctgcaccccgggtccggcaagacgcggaagtacctgcccgccatcgtccgcgaggccatcaagcggcgcctccggaccctgatcctggccccgacccgcgtggtggccgcggagatggaggaggccctcaaggggctgcccatccggtaccagaccacggccaccaagagcgagcacaccggccgcgagatcgtcgacctgatgtgccacgccaccttcacgatgcggctcctgtcccccgtgcgcgtgcccaactacaacctgatcatcatggacgaggcccacttcaccgacccggcgagcatcgccgcccgggggtacatctccacccgcgtcggcatgggcgaggccgcggccatcttcatgaccgccacgccgcccgggaccgccgacgccttcccccagagcaacgcgccgatccaggacgaggagcgcgacatccccgagcggtcctggaacagcggcaacgagtggatcaccgacttcgccgggaagaccgtgtggttcgtgccctccatcaaggccggcaacgacatcgccaactgcctccgcaagaacgggaagaaggtcatccagctgagccggaagacgttcgacaccgagtaccagaagaccaagctgaacgactgggacttcgtggtgaccacggacatctccgagatgggcgccaacttcaaggcggaccgcgtcatcgacccccggcgctgcctcaagccggtgatcctgaccgacggccccgagcgggtgatcctggccgggcccatgcccgtcaccgccgccagcgccgcgcagcgccggggccgcgtggggcggaacccgcagaaggagaacgaccagtacatcttcaccggccagcccctcaacaacgacgaggaccacgcccactggaccgaggccaagatgctgctggacaacatcaacacgcccgaggggatcatccccgccctcttcgagccggagcgcgagaagtccgcggccatcgacggcgagtaccggctgaagggcgagagccgcaagaccttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtacagcgaccccctggcgctcaaggagttcaaggacttcgccgccggccggaagtccatcgccctggacctggtgaccgagatcgggcgcgtgccgagccacctcgcccaccggacccgcaacgcgctggacaacctggtcatgctccacaccagcgagcacggcgggcgggcctaccgccacgccgtggaggagctgcccgagacgatggagaccctgctcctgctgggcctcatgatcctgctgaccgggggcgccatgctgttcctgatctccggcaaggggatcggcaagaccagcatcgggctgatctgcgtgatcgcctccagcggcatgctctggatggcggagatccccctgcagtggatcgcctccgccatcgtcctggagttcttcatgatggtgctcctgatcccggagcccgagaagcagcggacgccccaggacaaccagctggcctacgtggtcatcgggatcctcaccctggccgcgatcatcgccgccaacgagatgggcctgctcgagaccaccaagcgcgacctgggcatgagcaaggagcccggggtggtgtccccgacgagctacctggacgtcgacctccaccccgcctccgcgtggaccctgtacgccgtggccaccaccgtgatcacgcccatgctgcggcacaccatcgagaacagcaccgccaacgtctccctcgccgcgatcgccaaccaggccgtggtgctgatgggcctggacaaggggtggcccatcagcaagatggacctcggcgtcccgctgctggccctcgggtgctactcccaggtgaaccccctgaccctgacggccgcggtgctcctgctgatcacccactacgccatcatcggccccggcctccaggccaaggccacccgcgaggcccagaagcggaccgcggccgggatcatgaagaaccccacggtcgacggcatcatgaccatcgacctggacccggtgatctacgacagcaagttcgagaagcagctgggccaggtgatgctcctggtcctgtgcgccgtgcagctcctgctgatgcgcacctcctgggccctctgcgaggcgctgaccctggccacgggccccatcaccaccctctgggagggcagccccgggaagttctggaacaccacgatcgccgtgtccatggccaacatcttccggggcagctacctggccggggcgggcctggccttctccatcatgaagtccgtcgggaccggcaagcgcggcaccgggagccagggcgagaccctcggggagaagtggaagaagaagctgaaccagctgagccggaaggagttcgacctctacaagaagtccggcatcaccgaggtggaccgcacggaggccaaggaggggctgaagcggggcgagatcacccaccacgccgtgtcccgcggcagcgccaagctgcagtggttcgtcgagcggaacatggtgatccccgaggggcgcgtgatcgacctcggctgcgggcggggcgggtggtcctactactgcgcgggcctgaagaaggtcaccgaggtgcgcggctacaccaagggcgggccggggcacgaggagcccgtgcccatgagcacgtacggctggaacatcgtcaagctgatgtccgggaaggacgtgttctacctcccgcccgagaagtgcgacaccctgctgtgcgacatcggcgagagctcccccagccccaccgtggaggagtcccgcaccatccgggtcctgaagatggtggagccctggctcaagaacaaccagttctgcatcaaggtgctgaacccctacatgcccacggtcatcgagcacctggagcgcctccagcggaagcacggcgggatgctggtgcgcaaccccctgagccggaactccacccacgagatgtactggatcagcaacggcaccgggaacatcgtggcctccgtcaacatggtgagccgcctcctgctgaaccggttcaccatgacgcaccgccggcccaccatcgagaaggacgtggacctcggcgccggcacccgccacgtcaacgccgagccggagacccccaacatggacgtgatcggggagcggatcaagcgcatcaaggaggagcacaactccacgtggcactacgacgacgagaacccctacaagacctgggcctaccacggcagctacgaggtgaaggcgaccgggtccgccagcagcatgatcaacggcgtcgtgaagctgctgaccaagccgtgggacgtcgtgcccatggtgacgcagatggccatgaccgacaccacccccttcgggcagcagcgggtcttcaaggagaaggtggacacgcgcacgccccggtccatgccgggcacccgccgggtgatgggcatcaccgccgagtggctctggcgcacgctggggcggaacaagaagccccgcctgtgcacccgcgaggagttcaccaagaaggtccggaccaacgcggccatgggcgccgtgttcacggaggagaaccagtgggacagcgccaaggccgcggtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgcgatgtacgccgacgacaccgccgggtgggacacccggatcaccgaggacgacctgcacaacgaggagaagatcacgcagcagatggaccccgagcaccgccagctcgccaacgccatcttcaagctgacctaccagaacaaggtcgtgaaggtgcagcggccgacccccaccggcaccgtcatggacatcatctcccgcaaggaccagcggggcagcggccaggtgggcacgtacgggctgaacaccttcaccaacatggaggcgcagctcatccgccagatggagggcgagggggtgctgtccaaggccgacctggagaacccccacctccccgagaagaagatcacccagtggctggagacgaagggcgtcgagcggctgaagcgcatggccatcagcggcgacgactgcgtggtgaagccgatcgacgaccggttcgggaacgccctcctggccctgaacgacatgggcaaggtccgcaaggacatcccccagtggcagccctccaaggggtggcacgactggcagcaggtccccttctgcagccaccacttccacgagctcatcatgaaggacggccggaagctggtggtcccgtgccgcccccaggacgagctgatcgggcgggcgcgcatctcccagggcgccggctggagcctccgcgagaccgcctgcctggggaaggcctacgcgcagatgtggtccctgatgtacttccaccggcgcgacctccggctggccagcaacgccatctgctccgccgtgcccgtgcactgggtccccaccagccgcaccacgtggagcatccacgcccaccaccagtggatgaccaccgaggacatgctgaccgtgtggaaccgggtgtggatcgaggacaacccgtggatggaggacaagacgcccgtcaccacctgggagaacgtgccctacctcggcaagcgcgaggaccagtggtgcgggtccctgatcggcctgaccagccgggcgacgtgggcccagaacatccccaccgccatccagcaggtccgctccctcatcgggaacgaggagttcctggactacatgccgagcatgaagcggttccgcaaggaggaggagtccgagggcgccatctggtga

SEQ ID NO: 9822 - RNA, 9873 nt, synthetic construct
  misc_feature 1..9873: note = derived and/or modified CDS sequence (opt1) from DENV-3__KF954946__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgatcctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccaggggatcaccgccgagatcacgccccaggccagcacgaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgcgatgcacaccgccctcaccggggccacggagatccagaacagcggcgggacctccatcttcgccggccacctgaagtgccggctgaagatggacaagctcgagctgaagggcatgagctacgccatgtgcaccaacaccttcgtgctgaagaaggaggtctccgagacgcagcacgggaccatcctcatcaaggtggagtacaagggcgaggacgcgccgtgcaagatccccttcagcaccgaggacgggcagggcaaggcccacaacggccgcctgatcaccgccaaccccgtggtcacgaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacgtggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcaccaacgaggtgcacacgtggaccgagcagtacaagttccaggccgactcccccaagcgcctcgccaccgccatcgtgggcgcctgggagaacggggtctgcggcatccgcagcaccacgcggatggagaacctgctgtggaagcagatcgcgaacgagctcaactacatcctgtgggagaacaacatcaagctgaccgtggtggtcggggacaccatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgccgacatgggctactggatcgagagccagaagaacgggtcctggaagctcgagaaggcgagcctgatcgaggtcaagacctgcacgtggccgaagtcccacaccctgtggagcaacggcgtgctcgagtccgacatgatcatccccaagagcctggccgggcccatctcccagcacaactaccggccgggctaccacacccagaccgccgggccctggcacctgggcaagctcgagctggacttcaactactgcgagggcacgaccgtggtcatcaccgagaactgcgggacccgcggccccagcctgcggacgaccaccgtgtccgggaagctcatccacgagtggtgctgccgcagctgcaccctgcccccgctgcggtacatgggcgaggacgggtgctggtacggcatggagatccgccccatctccgagaaggaggagaacatggtcaagagcctcgtctccgccggcagcgggaaggtggacaacttcacgatgggcgtgctgtgcctggccatcctcttcgaggaggtcatgcgggggaagttcggcaagaagcacatgatcgcgggggtgttcttcaccttcgtgctgctgctctccggccagatcacctggcgcgacatggcccacaccctgatcatgatcggcagcaacgcctccgaccggatggggatgggcgtcacgtacctggccctcatcgccaccttcaagatccagcccttcctggcgctggggttcttcctccgcaagctgaccagccgggagaacctgctcctgggcgtgggcctggccatggccaccacgctccagctgcccgaggacatcgagcagatggccaacgggatcgcgctgggcctcatggccctgaagctgatcacccagttcgagacctaccagctctggaccgccctgatcagcctgacgtgctccaacaccatcttcaccctcaccgtggcctggcgcacggccaccctgatcctggcgggggtcagcctcctgccggtgtgccagtccagctccatgcggaagaccgactggctgcccatgaccgtcgccgccatgggcgtgccgcccctcccgctgttcatcttcagcctgaaggacacgctcaagcgccgctcctggcccctgaacgagggggtgatggccgtcggcctggtgagcatgctcgcctccagcctgctgcggaacgacgtgcccatggcgggccccctcgtcgccgggggcctgctgatcgcctgctacgtgatcaccgggacctccgccgacctcaccgtggagaaggccgcggacgtcacgtgggaggaggaggccgagcagaccggcgtgagccacaacctgatgatcaccgtggacgacgacgggaccatgcgcatcaaggacgacgagaccgagaacatcctgacggtcctcctgaagaccgccctgctcatcgtgtccggcatcttcccgtacagcatccccgccaccctgctggtgtggcacacctggcagaagcagacgcagcggtccggcgtcctctgggacgtgcccagcccgcccgagacccagaaggccgagctggaggagggggtgtaccgcatcaagcagcagggcatcctggggaagacccaggtcggcgtgggggtgcagaaggacggcgtcttccacaccatgtggcacgtgacgcggggcgcggtgctcacccacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccatggccgccatcatcgccgcgaacgagatgggcctgctggagaccaccaagcgggacctcggcatgtccaaggagccgggggtggtgagccccacgtcctacctggacgtcgacctgcaccccgccagcgcctggaccctctacgccgtggcgaccaccgtgatcacgcccatgctgcgccacaccatcgagaactccaccgccaacgtcagcctggccgccatcgccaaccaggcggtggtgctcctgggcctggacaaggggtggccgatctccaagatggacctcggcgtccccctgctggccctcgggtgctacagccaggtgaaccccctgaccctgacggccgccgtgctcctgctggtcacccactacgccatcatcggccccggcctccaggcgaaggccacccgggaggcccagaagcgcaccgccgccgggatcatgaagaacccgacggtggacggcatcatcaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtggaccggacggaggcgaaggaggggctgaagcgcggcgagaccacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccgcacgatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgtcccgcaacagcacccacgagatgtactggatctccaacggcaccgggaacatcgtcagctccgtgaacatggtgagccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaactccacgtggcactacgacgacgagaacccgtacaagacctgggcctaccacggcagctacgaggtcaaggccaccgggtccgccagcagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgccccatgcccggcacccggaaggtcatggagatcaccgccgagtggctctggcgcacgctgggccggaacaagcgcccccggctgtgcacccgcgaggagttcaccaagaaggtgcgcaccaacgccgccatgggggcggtgttcacggaggagaaccagtgggactccgccaaggccgccgtcgaggacgaggagttctggaagctcgtggaccgggagcgcgagctgcacaagctgggcaagtgcgggagctgcgtgtacaacatgatgggcaagcgggagaagaagctcggggagttcggcaaggccaagggctcccgcgcgatctggtacatgtggctgggggcccggtacctggagttcgaggccctcggcttcctgaacgaggaccactggttcagccgcgagaactcctacagcggggtcgagggcgaggggctgcacaagctcggctacatcctgcgggacatctccaagatcccgggcggggccatgtacgccgacgacaccgcgggctgggacacccgcatcaccgaggacgacctgcacaacgaggagaagatcacgcagcagatggaccccgagcaccggctcctggccaacgccatcttcaagctgacctaccagaacaaggtggtgaaggtccagcgccccacccccaccgggaccgtgatggacatcatcagccggaaggaccagcgcggctccggccaggtggggacgtacggcctcaacaccttcaccaacatggaggcccagctggtccggcagatggagggggagggcgtgctgagcaagaccgacctcgagaacccgcacctccccgagaagaagatcacgcagtggctggagaccaagggggtggagcgcctcaagcggatggccatctccggcgacgactgcgtcgtgaagcccatcgacgaccgcttcgcgaacgccctgctggccctcaacgacatgggcaaggtgcggaaggacatcccccagtggcagccgagcaaggggtggcacgactggcagcaggtccccttctgctcccaccacttccacgagctgatcatgaaggacggccgcaagctggtggtgccctgccggccccaggacgagctcatcgggcgcgcccggatcagccagggcgccgggtggtccctgcgcgagaccgcgtgcctgggcaaggcctacgcccagatgtggagcctcatgtacttccaccgccgggacctgcgcctggcctccaacgcgatctgcagcgccatcccggtccactgggtgcccacctcccggacgacctggagcatccacgcccaccaccagtggatgaccaccgaggacatgctcacggtgtggaaccgcgtctggatcgaggacaacccctggatggaggacaagacccccatcaccacctgggagaacgtgccgtacctgggcaagcgggaggaccagtggtgcgggagcctgatcggcctcacgtcccgcgccacctgggcccagaacatccccaccgcgatccagcaggtccggagcctgatcgggaacgaggagttcctggactacatgccctccatgaagcgcttccggaaggaggaggagagcgagggcgccatctggtga

SEQ ID NO: 9823 - RNA, 9873 nt, synthetic construct
  misc_feature 1..9873: note = derived and/or modified CDS sequence (opt1) from DENV-3__KF954947__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccaggggatcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgcgccgtgcaagatccccttcagcaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgtgggcgcctgggagaacggggtctgcggcatccgcagcacgacccggatggagaacctgctgtggaagcagatcgcgaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgccgacatgggctactggatcgagagccagaagaacgggtcctggaagctcgagaaggcgagcctgatcgaggtcaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtggtcatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtctccgccggcagcgggaaggtggacaacttcaccatgggcgtgctgtgcctggccatcctcttcgaggaggtcatgcgggggaagttcggcaagaagcacatgatcgcgggggtgttcttcaccttcgtgctgctgctctccggccagatcacctggcgcgacatggcccacacgctgatcatgatcggcagcaacgcctccgaccggatggggatgggcgtcacctacctggccctcatcgccaccttcaagatccagcccttcctggcgctggggttcttcctccgcaagctgaccagccgggagaacctgctcctgggcgtgggcctggccatggccacgaccctccagctgcccgaggacatcgagcagatggccaacgggatcgcgctgggcctcatggccctgaagctgatcacccagttcgagacctaccagctctggacggccctgatcagcctgacctgctccaacaccatcttcaccctcacggtggcctggcgcaccgccaccctgatcctggcgggggtcagcctcctgccggtgtgccagtccagctccatgcggaagaccgactggctgcccatgacggtcgccgccatgggcgtgccgcccctcccgctgttcatcttcagcctgaaggacaccctcaagcgccgctcctggcccctgaacgagggggtgatggccgtcggcctggtgagcatgctcgcctccagcctgctgcggaacgacgtgcccatggcgggccccctcgtcgccgggggcctgctgatcgcctgctacgtgatcaccgggacctccgccgacctcacggtggagaaggccgcggacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggccgagctggaggagggggtgtaccgcatcaagcagcagggcatcctggggaagacccaggtcggcgtgggggtgcagaaggacggcgtcttccacacgatgtggcacgtgacccggggcgcggtgctcacccacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtccgggaggcgatcaagcgccggctccgcaccctgatcctggcccccacccgggtggtggccgccgagatggaggaggccctcaaggggctgcccatccgctaccagacgaccgcgaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtgcccagcatcaaggcgggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccatggccgccatcatcgccgcgaacgagatgggcctgctggagaccacgaagcgggacctcggcatgtccaaggagccgggggtggtgagccccacctcctacctggacgtcgacctgcaccccgccagcgcctggaccctctacgccgtggcgaccacggtgatcacccccatgctgcgccacaccatcgagaactccaccgccaacgtcagcctggccgccatcgccaaccaggcggtggtgctcatgggcctggacaaggggtggccgatctccaagatggacctgggcgtccccctcctggccctggggtgctacagccaggtgaaccccctcacgctgaccgccgccgtgctgctcctggtcacccactacgccatcatcggccccggcctgcaggcgaaggccacccgggaggcccagaagcgcacggccgccgggatcatgaagaacccgaccgtggacggcatcatcaccatcgacctcgaccccgtgatctacgactccaagttcgagaagcagctggggcaggtcatgctgctcgtgctgtgcgcggtgcagctgctcctgatgcggaccagctgggccctgtgcgaggccctcacgctggccaccggccccatcaccaccctgtgggagggctcccccgggaagttctggaacacgaccatcgcggtcagcatggccaacatcttccgcggctcctacctcgccggggccggcctggccttcagcatcatgaagtccgtggggaccggcaagcggggcaccgggagccagggcgagaccctgggggagaagtggaagaagaagctcaaccagctgagccgcaaggagttcgacctgtacaagaagtccggcatcacggaggtggaccggaccgaggcgaaggaggggctcaagcgcggcgagaccacccaccacgccgtcagccggggctccgccaagctgcagtggttcgtggagcgcaacatggtgatcccggaggggcgggtcatcgacctgggctgcgggcgcggcgggtggagctactactgcgccggcctcaagaaggtgacggaggtgcggggctacaccaagggcgggcccgggcacgaggagcccgtccccatgtccacctacggctggaacatcgtgaagctgatgagcgggaaggacgtgttctacctgccgcccgagaagtgcgacaccctcctgtgcgacatcggcgagtccagcccctcccccacggtcgaggagagccgcaccatccgcgtgctgaagatggtggagccgtggctgaagaacaaccagttctgcatcaaggtcctcaacccctacatgcccgccgtgatcgagcacctggagcggctgcagcgcaagcacggcgggatgctcgtgcggaaccccctgtcccgcaacagcacccacgagatgtactggatctccaacggcaccgggaacatcgtcagctccgtgaacatggtgagccggctgctcctgaaccgcttcacgatgacccaccggcgcccgaccatcgagaaggacgtcgacctgggcgcgggcacccggcacgtgaacgccgagcccgagacgcccaacatggacgtgatcggggagcgcatcaagcggatcaaggaggagcacaactccacctggcactacgacgacgagaacccgtacaagacctgggcctaccacggcagctacgaggtcaaggccaccgggtccgccagcagcatgatcaacggcgtggtcaagctcctgacgaagccctgggacgtggtgcccatggtcacccagatggcgatgaccgacaccacgcccttcgggcagcagcgcgtgttcaaggagaaggtggacacccggaccccgcgccccatgcccggcacccggaaggtcatggagatcacggccgagtggctgtggcgcaccctcggccggaacaagcgcccccggctgtgcacccgcgaggagttcaccaagaaggtgcgcacgaacgccgccatgggggcggtgttcaccgaggagaaccagtgggactccgccaaggccgccgtcgaggacgaggagttctggaagctggtggaccgggagcgcgagctccacaagctgggcaagtgcgggagctgcgtgtacaacatgatgggcaagcgggagaagaagctgggggagttcggcaaggccaagggctcccgcgcgatctggtacatgtggctcggggcccggtacctggagttcgaggccctgggcttcctcaacgaggaccactggttcagccgcgagaactcctacagcggggtcgagggcgaggggctgcacaagctgggctacatcctccgggacatctccaagatcccgggcggggccatgtacgccgacgacaccgcgggctgggacacccgcatcacggaggacgacctgcacaacgaggagaagatcacccagcggatggaccccgagcaccgcctgctcgccaacgccatcttcaagctgacctaccagaacaaggtggtgaaggtccagcggcccacccccaccgggacggtgatggacatcatcagccgcaaggaccagcggggctccggccaggtggggacctacggcctgaacaccttcaccaacatggaggcccagctcgtccgccagatggagggggagggcgtgctgagcaagacggacctggagaacccgcacctccccgagaagaagatcacccagtggctggagaccaagggggtggagcggctgaagcgcatggccatctccggcgacgactgcgtcgtgaagcccatcgacgaccggttcgcgaacgccctcctggccctgaacgacatgggcaaggtgcgcaaggacatcccccagtggcagccgagcaaggggtggcacgactggcagcaggtccccttctgctcccaccacttccacgagctcatcatgaaggacggccggaagctggtggtgccctgccgcccccaggacgagctgatcgggcgggcccgcatcagccagggcgccgggtggtccctccgcgagaccgcgtgcctgggcaaggcctacgcccagatgtggagcctgatgtacttccaccggcgcgacctccggctggcctccaacgcgatctgcagcgccatcccggtccactgggtgcccacgtcccgcaccacctggagcatccacgcccaccaccagtggatgaccacggaggacatgctgaccgtgtggaaccgggtctggatcgaggacaacccctggatggaggacaagacccccatcaccacgtgggagaacgtgccgtacctcggcaagcgcgaggaccagtggtgcgggagcctgatcggcctgacctcccgggccacctgggcccagaacatccccaccgcgatccagcaggtccgcagcctcatcgggaacgaggagttcctggactacatgccctccatgaagcggttccgcaaggaggaggagagcgagggcgccatctggtga

SEQ ID NO: 9824 - RNA, 9873 nt, synthetic construct
  misc_feature 1..9873: note = derived and/or modified CDS sequence (opt1) from DENV-3__KF954945__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgatcctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccaggggatcaccgccgagatcacgccccaggccagcacgaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgcgatgcacaccgccctcaccggggccacggagatccagaacagcggcgggacctccatcttcgccggccacctgaagtgccggctgaagatggacaagctcgagctgaagggcatgagctacgccatgtgcaccaacaccttcgtgctgaagaaggaggtctccgagacgcagcacgggaccatcctcatcaaggtggagtacaagggcgaggacgcgccgtgcaagatccccttcagcaccgaggacgggcagggcaaggcccacaacggccgcctgatcaccgccaaccccgtggtcacgaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacgtggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcaccaacgaggtgcacacgtggaccgagcagtacaagttccaggccgactcccccaagcgcctcgccaccgccatcgtgggcgcctgggagaacggggtctgcggcatccgcagcaccacgcggatggagaacctgctgtggaagcagatcgcgaacgagctcaactacatcctgtgggagaacaacatcaagctgaccgtggtggtcggggacaccatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgccgacatgggctactggatcgagagccagaagaacgggtcctggaagctcgagaaggcgagcctgatcgaggtcaagacctgcacgtggccgaagtcccacaccctgtggagcaacggcgtgctcgagtccgacatgatcatccccaagagcctggccgggcccatctcccagcacaactaccggccgggctaccacacccagaccgccgggccctggcacctgggcaagctcgagctggacttcaactactgcgagggcacgaccgtggtcatcaccgagaactgcgggacccgcggccccagcctgcggacgaccaccgtgtccgggaagctcatccacgagtggtgctgccgcagctgcaccctgcccccgctgcggtacatgggcgaggacgggtgctggtacggcatggagatccgccccatctccgagaaggaggagaacatggtcaagagcctcgtctccgccggcagcgggaaggtggacaacttcacgatgggcgtgctgtgcctggccatcctcttcgaggaggtcatgcgggggaagttcggcaagaagcacatgatcgcgggggtgttcttcaccttcgtgctgctgctctccggccagatcacctggcgcgacatggcccacaccctgatcatgatcggcagcaacgcctccgaccggatggggatgggcgtcacgtacctggccctcatcgccaccttcaagatccagcccttcctggcgctggggttcttcctccgcaagctgaccagccgggagaacctgctcctgggcgtgggcctggccatggccaccacgctccagctgcccgaggacatcgagcagatggccaacgggatcgcgctgggcctcatggccctgaagctgatcacccagttcgagacctaccagctctggaccgccctgatcagcctgacgtgctccaacaccatcttcaccctcaccgtggcctggcgcacggccaccctgatcctggcgggggtcagcctcctgccggtgtgccagtccagctccatgcggaagaccgactggctgcccatgaccgtcgccgccatgggcgtgccgcccctcccgctgttcatcttcagcctgaaggacacgctcaagcgccgctcctggcccctgaacgagggggtgatggccgtcggcctggtgagcatgctcgcctccagcctgctgcggaacgacgtgcccatggcgggccccctcgtcgccgggggcctgctgatcgcctgctacgtgatcaccgggacctccgccgacctcaccgtggagaaggccgcggacgtcacgtgggaggaggaggccgagcagaccggcgtgagccacaacctgatgatcaccgtggacgacgacgggaccatgcgcatcaaggacgacgagaccgagaacatcctgacggtcctcctgaagaccgccctgctcatcgtgtccggcatcttcccgtacagcatccccgccaccctgctggtgtggcacacctggcagaagcagacgcagcggtccggcgtcctctgggacgtgcccagcccgcccgagacccagaaggccgagctggaggagggggtgtaccgcatcaagcagcagggcatcctggggaagacccaggtcggcgtgggggtgcagaaggacggcgtcttccacaccatgtggcacgtgacgcggggcgcggtgctcacccacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccatggccgccatcatcgccgcgaacgagatgggcctgctggagaccaccaagcgggacctcggcatgtccaaggagccgggggtggtgagccccacgtcctacctggacgtcgacctgcaccccgccagcgcctggaccctctacgccgtggcgaccaccgtgatcacgcccatgctgcgccacaccatcgagaactccaccgccaacgtcagcctggccgccatcgccaaccaggcggtggtgctcatgggcctggacaaggggtggccgatctccaagatggacctgggcgtccccctcctggccctggggtgctacagccaggtgaaccccctcaccctgacggccgccgtgctgctcctggtcacccactacgccatcatcggccccggcctgcaggcgaaggccacccgggaggcccagaagcgcaccgccgccgggatcatgaagaacccgacggtggacggcatcatcaccatcgacctcgaccccgtgatctacgactccaagttcgagaagcagctggggcaggtcatgctgctcgtgctgtgcgcggtgcagctgctcctgatgcggaccagctgggccctgtgcgaggccctcaccctggccacgggccccatcaccaccctgtgggagggctcccccgggaagttctggaacaccacgatcgcggtcagcatggccaacatcttccgcggctcctacctcgccggggccggcctggccttcagcatcatgaagtccgtggggaccggcaagcggggcaccgggagccagggcgagaccctgggggagaagtggaagaagaagctcaaccagctgagccgcaaggagttcgacctgtacaagaagtccggcatcaccgaggtggaccggacggaggcgaaggaggggctcaagcgcggcgagaccacccaccacgccgtcagccggggctccgccaagctgcagtggttcgtggagcgcaacatggtgatcccggaggggcgggtcatcgacctgggctgcgggcgcggcgggtggagctactactgcgccggcctcaagaaggtgaccgaggtgcggggctacacgaagggcgggcccgggcacgaggagcccgtccccatgtccacctacggctggaacatcgtgaagctgatgagcgggaaggacgtgttctacctgccgcccgagaagtgcgacaccctcctgtgcgacatcggcgagtccagcccctcccccaccgtcgaggagagccgcacgatccgcgtgctgaagatggtggagccgtggctgaagaacaaccagttctgcatcaaggtcctcaacccctacatgcccgccgtgatcgagcacctggagcggctgcagcgcaagcacggcgggatgctcgtgcggaaccccctgtcccgcaacagcacccacgagatgtactggatctccaacggcaccgggaacatcgtcagctccgtgaacatggtgagccggctgctcctgaaccgcttcaccatgacgcaccggcgcccgaccatcgagaaggacgtcgacctgggcgcgggcacccggcacgtgaacgccgagcccgagacccccaacatggacgtgatcggggagcgcatcaagcggatcaaggaggagcacaactccacgtggcactacgacgacgagaacccgtacaagacctgggcctaccacggcagctacgaggtcaaggccaccgggtccgccagcagcatgatcaacggcgtggtcaagctcctgaccaagccctgggacgtggtgcccatggtcacgcagatggcgatgaccgacaccacccccttcgggcagcagcgcgtgttcaaggagaaggtggacacgcggaccccgcgccccatgcccggcacccggaaggtcatggagatcaccgccgagtggctgtggcgcacgctcggccggaacaagcgcccccggctgtgcacccgcgaggagttcaccaagaaggtgcgcaccaacgccgccatgggggcggtgttcacggaggagaaccagtgggactccgccaaggccgccgtcgaggacgaggagttctggaagctggtggaccgggagcgcgagctccacaagctgggcaagtgcgggagctgcgtgtacaacatgatgggcaagcgggagaagaagctgggggagttcggcaaggccaagggctcccgcgcgatctggtacatgtggctcggggcccggtacctggagttcgaggccctgggcttcctcaacgaggaccactggttcagccgcgagaactcctacagcggggtcgagggcgaggggctgcacaagctgggctacatcctccgggacatctccaagatcccgggcggggccatgtacgccgacgacaccgcgggctgggacacccgcatcaccgaggacgacctgcacaacgaggagaagatcacgcagcagatggaccccgagcaccggctgctcgccaacgccatcttcaagctgacctaccagaacaaggtggtgaaggtccagcgccccacccccaccgggaccgtgatggacatcatcagccggaaggaccagcgcggctccggccaggtggggacgtacggcctgaacaccttcaccaacatggaggcccagctcgtccggcagatggagggggagggcgtgctgagcaagaccgacctggagaacccgcacctccccgagaagaagatcacgcagtggctggagaccaagggggtggagcgcctgaagcggatggccatctccggcgacgactgcgtcgtgaagcccatcgacgaccgcttcgcgaacgccctcctggccctgaacgacatgggcaaggtgcggaaggacatcccccagtggcagccgagcaaggggtggcacgactggcagcaggtccccttctgctcccaccacttccacgagctcatcatgaaggacggccgcaagctggtggtgccctgccggccccaggacgagctgatcgggcgcgcccggatcagccagggcgccgggtggtccctccgcgagaccgcgtgcctgggcaaggcctacgcccagatgtggagcctgatgtacttccaccgccgggacctccgcctggcctccaacgcgatctgcagcgccatcccggtccactgggtgcccacctcccggacgacctggagcatccacgcccaccaccagtggatgaccaccgaggacatgctgacggtgtggaaccgcgtctggatcgaggacaacccctggatggaggacaagacccccatcaccacctgggagaacgtgccgtacctcggcaagcgggaggaccagtggtgcgggagcctgatcggcctgacgtcccgcgccacctgggcccagaacatccccaccgcgatccagcaggtccggagcctcatcgggaacgaggagttcctggactacatgccctccatgaagcgcttccggaaggaggaggagagcgagggcgccatctggtga

SEQ ID NO: 9825 - RNA, 9873 nt, synthetic construct
  misc_feature 1..9873: note = derived and/or modified CDS sequence (opt1) from DENV-3__JX669495__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccggagcacgacccgcatggagaacctgctgtggaagcagatcgccaacgagctcaactacatcctgtgggagaacaacatcaagctgaccgtggtggtcggggacatcatcggcgtgctcgagcagggcaagcggaccctgacgccccagccgatggagctgaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccgcccgggctaccacacccagaccgccgggccctggcacctcggcaagctggagctggacttcaactactgcgagggcacgaccgtggtcatcaccgagaactgcgggacccggggccccagcctccgcacgaccaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtctccgccggcagcgggaaggtggacaacttcacgatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacaccctgatcatgatcggcagcaacgcctccgaccgcatggggatgggcgtcacgtacctcgccctgatcgcgaccttcaagatccagcccttcctggccctcgggttcttcctgcggaagctgaccagccgcgagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcggacggcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacaccctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcggatcaaggacgacgagaccgagaacatcctcaccgtgctgctgaagacggccctcctgatcgtctccggcgtgttcccgtacagcatccccgcgaccctgctcgtgtggcacacctggcagaagcagacccagcgctccggcgtcctgtgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctcacgtacaacgggaagcggctggagcccaactgggcctccgtcaagaaggacctgatcagctacggcgggggctggcgcctctccgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctcaccatcatggacctgcaccccgggagcggcaagacccggaagtacctgccggccatcgtccgcgaggccatcaagcggcgcctccggacgctgatcctggcccccacccgcgtggtggccgcggagatggaggaggccctcaaggggctgcccatccggtaccagaccaccgccacgaagtccgagcacaccggccgcgagatcgtcgacctgatgtgccacgccaccttcaccatgcggctcctgagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctccgcaagaacgggaagaaggtcatccagctgtcccggaagaccttcgacacggagtaccagaagaccaagctgaacgactgggacttcgtggtgaccaccgacatcagcgagatgggcgccaacttcaaggcggaccgcgtcatcgacccgcggcgctgcctcaagcccgtgatcctgacggacggccccgagcgggtgatcctggccgggcccatgccggtcaccgccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagacgttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacctactccgacccgctggcgctcaaggagttcaaggacttcgccgccggccgcaagagcatcgccctggacctggtgacggagatcgggcgcgtgccctcccacctcgcccaccggacccgcaacgcgctggacaacctggtcatgctccacaccagcgagcacggcgggcgggcctaccgccacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcacgctggccgcgatcatcgccgccaacgagatgggcctgctcgagaccaccaagcgcgacctgggcatgtccaaggagccgggggtggtgagccccacctcctacctggacgtcgacctccaccccgccagcgcgtggacgctgtacgccgtggccaccaccgtgatcacccccatgctgcggcacacgatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacgcactacgccatcatcggccccggcctccaggccaaggccacccgcgaggcccagaagcggaccgcggccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcgcaccagctgggccctctgcgaggcgctgaccctggccaccggccccatcacgaccctctgggagggctcccccgggaagttctggaacaccaccatcgccgtgagcatggccaacatcttccggggctcctacctggccggggcgggcctggccttcagcatcatgaagtccgtcgggacgggcaagcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagatcacgcaccacgccgtgagccgcggctccgccaagctgcagtggttcgtcgagcggaacatggtgatcccggaggggcgcgtgatcgacctcggctgcgggcggggcgggtggagctactactgcgcgggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgccgagtggctctggcgcaccctggggcggaacaagaagccccgcctgtgcacgcgcgaggagttcaccaagaaggtccggaccaacgcggccatgggcgccgtgttcaccgaggagaaccagtgggactccgccaaggccgcggtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgcgatgtacgccgacgacacggccgggtgggacacccggatcaccgaggacgacctgcacaacgaggagaagatcacccagcagatggacccggagcaccgccagctcgccaacgccatcttcaagctgacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcgcagctcatccgccagatggagggcgagggggtgctgagcaaggccgacctggagaacccccacctcccggagaagaaggtcacccagtggctggagaccaagggcgtggagcggctgaagcgcatggccatctccggcgacgactgcgtggtcaagcccatcgacgaccggttcgccaacgccctcctggcgctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggccggctggtccctccgcgagacggcctgcctgggcaaggcgtacgcccagatgtggagcctgatgtacttccaccggcgcgacctccggctggcctccaacgccatctgcagcgccgtgcccgtccactgggtgccgacctcccgcaccacctggagcatccacgcgcaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggcagcctgatcgggctgacctcccgggccacctgggcccagaacatcccgacggccatccagcaggtccgcagcctcatcggcaacgaggagttcctggactacatgccctccatgaagcggttccgcaaggaggaggagagcgagggggccatctggtga

SEQ ID NO: 9826 - RNA, 9873 nt, synthetic construct
  misc_feature 1..9873: note = derived and/or modified CDS sequence (opt1) from DENV-3__JX669499__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccggagcacgacccgcatggagaacctgctgtggaagcagatcgccaacgagctcaactacatcctgtgggagaacaacatcaagctgaccgtggtggtcggggacatcatcggcgtgctcgagcagggcaagcggaccctgacgccccagccgatggagctgaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccgcccgggctaccacacccagaccgccgggccctggcacctcggcaagctggagctggacttcaactactgcgagggcacgaccgtggtcatcaccgagaactgcgggacccggggccccagcctccgcacgaccaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtctccgccggcagcgggaaggtggacaacttcacgatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacaccctgatcatgatcggcagcaacgcctccgaccgcatggggatgggcatcacgtacctcgccctgatcgcgaccttcaagatccagcccttcctggccctcgggttcttcctgcggaagctgaccagccgcgagaacctcctgctgggcgtcggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcggacggcgaccctgatcctcgccggggtgagcctgctgccggtctgccagtccagctccatgcgcaagaccgactggctccccatggccgtggccgccatgggcgtgccgcccctcccgctgttcatcttcagcctcaaggacaccctgaagcgccggtcctggcccctgaacgagggggtgatggcggtgggcctcgtcagcatcctggcctccagcctgctccgcaacgacgtgcccatggccggccccctggtggccgggggcctgctcatcgcctgctacgtcatcacggggacctccgcggacctgaccgtggagaaggccgccgacatcacctgggaggaggaggccgagcagacgggcgtgagccacaacctgatgatcaccgtcgacgacgacgggaccatgcggatcaaggacgacgagaccgagaacatcctcaccgtgctgctgaagacggccctcctgatcgtgtccggcgtcttcccgtacagcatccccgcgaccctgctcgtgtggcacacctggcagaagcagacccagcgctccggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggcctccgtgaagaaggacctgatcagctacggcgggggctggcgcctctccgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggcagccccatcatcaaccgggagggcaaggtcgtggggctgtacggcaacggggtggtcaccaagaacggcgggtacgtgtccggcatcgcccagacgaacgcggagccggacggccccacccccgagctggaggaggagatgttcaagaagcgcaacctcaccatcatggacctgcaccccgggagcggcaagacccggaagtacctgccggccatcgtgcgcgaggccatcaagcggcgcctccggacgctgatcctggcccccacccgcgtcgtggccgcggagatggaggaggccctcaaggggctgcccatccggtaccagaccaccgccacgaagtccgagcacaccggccgcgagatcgtggacctgatgtgccacgccaccttcaccatgcggctcctgagccccgtccgcgtgccgaactacaacctgatcatcatggacgaggcccacttcacggaccccgcgtccatcgccgcccgggggtacatcagcacccgcgtgggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtctggttcgtgcccagcatcaaggccggcaacgacatcgccaactgcctccgcaagaacgggaagaaggtgatccagctgtcccggaagaccttcgacacggagtaccagaagaccaagctgaacgactgggacttcgtcgtgaccaccgacatcagcgagatgggcgccaacttcaaggcggaccgcgtgatcgacccgcggcgctgcctcaagcccgtcatcctgacggacggccccgagcgggtgatcctggccgggcccatgccggtgaccgccgcctccgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagacgttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctactccgacccgctggcgctcaaggagttcaaggacttcgccgccggccgcaagagcatcgccctggacctggtcacggagatcgggcgcgtgccctcccacctcgcccaccggacccgcaacgcgctggacaacctggtgatgctccacaccagcgagcacggcgggcgggcctaccgccacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcggacgccccaggacaaccagctggcctacgtggtgatcgggatcctcacgctggccgcgatcatcgccgccaacgagatgggcctgctcgagaccaccaagcgcgacctgggcatgtccaaggagccgggggtcgtgagccccacctcctacctggacgtggacctccaccccgccagcgcgtggacgctgtacgccgtcgccaccaccgtgatcacccccatgctgcggcacacgatcgagaactccaccgccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacgcactacgccatcatcggccccggcctccaggccaaggccacccgcgaggcccagaagcggaccgcggccgggatcatgaagaacccgaccgtggacggcatcatgacgatcgacctggaccccgtcatctacgactccaagttcgagaagcagctgggccaggtgatgctcctggtgctgtgcgccgtccagctcctgctgatgcgcaccagctgggccctctgcgaggcgctgaccctggccaccggccccatcacgaccctctgggagggctcccccgggaagttctggaacaccaccatcgccgtgagcatggccaacatcttccggggctcctacctggccggggcgggcctggccttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtcgaccgcaccgaggccaaggaggggctgaagcggggcgagatcacgcaccacgccgtgagccgcggctccgccaagctgcagtggttcgtggagcggaacatggtcatcccggaggggcgcgtgatcgacctcggctgcgggcggggcgggtggagctactactgcgcgggcctgaagaaggtgaccgaggtccgcggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccgcaccatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacgcacgagatgtactggatctccaacggcaccgggaacatcgtggccagcgtgaacatggtctcccgcctcctgctgaaccggttcaccatgacccaccgccggccgacgatcgagaaggacgtggacctcggcgccggcacccgccacgtgaacgccgagcccgagacccccaacatggacgtcatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtggtcaagctgctgaccaagccctgggacgtggtccccatggtgacccagatggccatgacggacaccacccccttcgggcagcagcgggtgttcaaggagaaggtcgacacccgcacgccgcggagcatgcccggcacccgccgggtgatgggcatcaccgccgagtggctctggcgcaccctggggcggaacaagaagccccgcctgtgcacgcgcgaggagttcaccaagaaggtgcggaccaacgcggccatgggcgccgtcttcaccgaggagaaccagtgggactccgccaaggccgcggtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgcgatgtacgccgacgacacggccgggtgggacacccggatcaccgaggacgacctgcacaacgaggagaagatcacccagcagatggacccggagcaccgccagctcgccaacgccatcttcaagctgacgtaccagaacaaggtggtcaaggtgcagcggcccacccccaccggcaccgtgatggacatcatcagccgcaaggaccagcggggctccgggcaggtcggcacctacgggctgaacacgttcaccaacatggaggcgcagctcatccgccagatggagggcgagggggtgctgagcaaggccgacctggagaacccccacctcccggagaagaagatcacccagtggctggagaccaagggcgtggagcggctgaagcgcatggccatctccggcgacgactgcgtcgtgaagcccatcgacgaccggttcgccaacgccctcctggcgctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctccgcgagacggcctgcctgggcaaggcgtacgcccagatgtggagcctgatgtacttccaccggcgcgacctccggctggcctccaacgccatctgcagcgccgtccccgtgcactgggtgccgacctcccgcaccacctggagcatccacgcgcaccaccagtggatgacgaccgaggacatgctgaccgtctggaaccgggtgtggatcgaggacaacccctggatggaggacaagacccccgtgacgacctgggagaacgtcccctacctcgggaagcgcgaggaccagtggtgcggcagcctgatcgggctgacctcccgggccacctgggcccagaacatcccgacggccatccagcaggtccgcagcctcatcggcaacgaggagttcctggactacatgccctccatgaagcggttccgcaaggaggaggagagcgagggggccatctggtga

SEQ ID NO: 9827 - RNA, 9873 nt, synthetic construct
  misc_feature 1..9873: note = derived and/or modified CDS sequence (opt1) from DENV-3__JX669492__SS-prME
  source 1..9873: mol_type = other RNA
accagcttctgcctgatgatgatcctccccgcggccctggcgttccacctgaccagccgggacggggagccgcggatgatcgtggggaagaacgagcgcggcaagagcctcctgttcaagaccgcctccgggatcaacatgtgcaccctgatcgccatggacctcggggagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctggcgccccacgtgggcatggggctcgacacccggacccagacctggatgagcgccgagggcgcctggcgccaggtggagaaggtggagacgtgggccctgcggcacccggggttcaccatcctggccctcttcctggcccactacatcggcacctccctgacccagaaggtggtgatcttcatcctcctgatgctggtgacgcccagcatgaccatgcgctgcgtgggggtgggcaaccgggacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcgcaagctctgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctgttcgggaagggctccctcgtgacctgcgccaagttccagtgcctggagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctccccgagtacggcaccctggggctggagtgctccccgcggaccggcctcgacttcaacgagatgatcctgctgacgatgaagaacaaggcctggatggtgcaccgccagtggttcttcgacctccccctgccctggaccagcggcgccaccaccgagacgcccacctggaaccggaaggagctgctcgtgaccttcaagaacgcccacgccaagaagcaggaggtcgtggtgctggggtcccaggagggcgcgatgcacaccgccctgacgggggccaccgagatccagaacagcggcgggacctccatcttcgccggccacctcaagtgccgcctgaagatggacaagctggagctcaagggcatgagctacgccatgtgcaccaacacgttcgtcctgaagaaggaggtgtccgagacccagcacgggaccatcctgatcaaggtggagtacaagggcgaggacgcgccgtgcaagatccccttcagcaccgaggacgggcagggcaaggcccacaacggccggctcatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctgaacagcctcggcaagatggtccaccagatcttcgggtccgcctacacggccctgttcagcggcgtgtcctgggtgatgaagatcggcatcggggtcctgctcacctggatcggcctgaacagcaagaacacctccatgagcttctcctgcatcgccatcgggatcatcaccctgtacctcggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctggccaccgccatcgccggcgcgtgggagaacggggtctgcggcatccggagcacgacccgcatggagaacctcctgtggaagcagatcgccaacgagctgaactacatcctctgggagaacaacatcaagctgaccgtggtggtcggggacatcatcggcgtgctggagcagggcaagcggaccctcacgccccagccgatggagctgaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctgaagctccgggaggtctacacccagctgtgcgaccaccgcctgatgagcgccgccgtgaaggacgagcgggccgtgcacgcggacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggccgggcccatctcccagcacaaccaccgcccgggctaccacacccagaccgccgggccctggcacctgggcaagctcgagctggacttcaactactgcgagggcacgaccgtggtcatcaccgagaactgcgggacccggggccccagcctgcgcacgaccaccgtgtccgggaagctcatccacgagtggtgctgccggagctgcaccctgcccccgctgcgctacatgggcgaggacgggtgctggtacggcatggagatccggcccatctccgagaaggaggagaacatggtcaagagcctcgtctccgccggcagcgggaaggtggacaacttcacgatgggcgtgctgtgcctggcgatcctcttcgaggaggtcatgcgcgggaagttcggcaagaagcacatgatcgccggggtgttcttcaccttcgtgctgctgctctccggccagatcacctggcgggacatggcccacaccctgatcatgatcggcagcaacgcctccgaccgcatggggatgggcgtcacgtacctggccctcatcgcgaccttcaagatccagcccttcctggccctggggttcttcctccggaagctgaccagccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatcagcctgacgtgctccaacaccatgttcaccctcaccgtggcctggcggacggcgaccctgatcctggccggggtcagcctcctgccggtgtgccagtccagctccatgcgcaagaccgactggctgcccatggccgtcgccgccatgggcgtgccgcccctcccgctgttcatcttcagcctgaaggacaccctcaagcgccggtcctggcccctgaacgagggggtgatggcggtcggcctggtgagcatcctcgcctccagcctgctgcgcaacgacgtgcccatggccggccccctcgtcgccgggggcctgctgatcgcctgctacgtgatcacggggacctccgcggacctcaccgtggagaaggccgccgacatcacctgggaggaggaggccgagcagacgggcgtcagccacaacctgatgatcaccgtggacgacgacgggaccatgcggatcaaggacgacgagaccgagaacatcctgaccgtgctcctgaagacggccctgctcatcgtctccggcgtgttcccgtacagcatccccgcgaccctgctggtgtggcacacctggcagaagcagacccagcgctccggcgtcctctgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggcctccgtcaagaaggacctgatcagctacggcgggggctggcgcctgtccgcgcagtggcagaagggggaggaggtccaggtgatcgccgtcgagcccggcaagaaccccaagaacttccagaccatgcccggcaccttccagaccacgaccggggagatcggcgccatcgccctcgacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctgaccatcatggacctccaccccgggagcggcaagacccggaagtacctgccggccatcgtccgcgaggccatcaagcggcgcctgcggacgctcatcctggcccccacccgcgtggtggccgcggagatggaggaggccctgaaggggctccccatccggtaccagaccaccgccacgaagtccgagcacaccggccgcgagatcgtcgacctgatgtgccacgccaccttcaccatgcggctgctcagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctctcccggaagaccttcgacacggagtaccagaagaccaagctgaacgactgggacttcgtggtgaccaccgacatcagcgagatgggcgccaacttcaaggcggaccgcgtcatcgacccgcggcgctgcctgaagcccgtgatcctcacggacggccccgagcgggtgatcctggccgggcccatgccggtcaccgccgcctccgccgcgcagcgccggggccgcgtggggcggaacccccagaaggagaacgaccagtacatcttcaccggccagcccctgaacaacgacgaggaccacgcccactggaccgaggccaagatgctcctggacaacatcaacacccccgaggggatcatcccggccctgttcgagcccgagcgcgagaagtccgcggccatcgacggcgagtaccggctcaagggcgagtcccgcaagacgttcgtggagctgatgcggcgcggggacctgcccgtctggctcgcccacaaggtggccagcgagggcatcaagtacaccgaccggaagtggtgcttcgacgggcagcgcaacaaccagatcctggaggagaacatggacgtcgagatctggaccaaggagggcgagaagaagaagctgcggccccgctggctcgacgcccgcacctactccgacccgctggcgctgaaggagttcaaggacttcgccgccggccgcaagagcatcgccctcgacctggtgacggagatcgggcgcgtgccctcccacctggcccaccggacccgcaacgcgctcgacaacctggtcatgctgcacaccagcgagcacggcgggcgggcctaccgccacgccgtggaggagctccccgagaccatggagacgctgctgctcctgggcctgatgatcctcctgaccgggggcgccatgctgttcctcatcagcggcaaggggatcggcaagacctccatcgggctgatctgcgtgatcgccagctccggcatgctgtggatggcggagatcccgctccagtggatcgccagcgccatcgtcctggagttcttcatgatggtgctgctcatccccgagcccgagaagcagcggacgccccaggacaaccagctggcctacgtggtcatcgggatcctgacgctcgccgcgatcatcgccgccaacgagatgggcctgctggagaccaccaagcgcgacctcggcatgtccaaggagccgggggtggtgagccccacctcctacctggacgtcgacctgcaccccgccagcgcgtggacgctctacgccgtggccaccaccgtgatcacccccatgctgcggcacacgatcgagaactccaccgccaacgtcagcctggccgcgatcgccaaccaggccgtggtgctcatgggcctggacaaggggtggccgatctccaagatggacctgggcgtccccctcctggccctggggtgctacagccaggtgaaccccctcaccctgaccgccgcggtgctgctcctgatcacgcactacgccatcatcggccccggcctgcaggccaaggccacccgcgaggcccagaagcggaccgcggccgggatcatgaagaacccgaccgtcgacggcatcatgacgatcgacctcgaccccgtgatctacgactccaagttcgagaagcagctgggccaggtgatgctgctcgtcctgtgcgccgtgcagctgctcctgatgcgcaccagctgggccctgtgcgaggcgctcaccctggccaccggccccatcacgaccctgtgggagggctcccccgggaagttctggaacaccaccatcgccgtgagcatggccaacatcttccggggctcctacctcgccggggcgggcctggccttcagcatcatgaagtccgtcgggacgggcaagcgcggcaccgggagccagggcgagaccctgggggagaagtggaagaagaagctcaaccagctgagccggaaggagttcgacctgtacaagaagtccggcatcaccgaggtggaccgcaccgaggccaaggaggggctcaagcggggcgagatcacgcaccacgccgtgagccgcggctccgccaagctgcagtggttcgtcgagcggaacatggtgatcccggaggggcgcgtgatcgacctgggctgcgggcggggcgggtggagctactactgcgcgggcctcaagaaggtcaccgaggtgcgcggctacaccaagggcgggcccgggcacgaggagcccgtgcccatgtccacctacggctggaacatcgtcaagctgatgagcgggaaggacgtgttctacctgccgcccgagaagtgcgacacgctcctgtgcgacatcggcgagtccagcccctcccccaccgtggaggagagccgcaccatccgggtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgtcccggaacagcacgcacgagatgtactggatctccaacggcaccgggaacatcgtggccagcgtcaacatggtgtcccgcctgctcctgaaccggttcaccatgacccaccgccggccgacgatcgagaaggacgtggacctgggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctcctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgccgagtggctgtggcgcaccctcgggcggaacaagaagccccgcctgtgcacgcgcgaggagttcaccaagaaggtccggaccaacgcggccatgggcgccgtgttcaccgaggagaaccagtgggactccgccaaggccgcggtggaggacgaggacttctggaagctggtcgaccgcgagcgggagctccacaagctggggaagtgcggcagctgcgtgtacaacatgatggggaagcgcgagaagaagctgggcgagttcggcaaggccaaggggtcccgggccatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgcgatgtacgccgacgacacggccgggtgggacacccggatcaccgaggacgacctgcacaacgaggagaagatcacccagcagatggacccggagcaccgccagctggccaacgccatcttcaagctcacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcgcagctgatccgccagatggagggcgagggggtgctcagcaaggccgacctggagaacccccacctccccgagaagaagatcacccagtggctggagaccaagggcgtcgagcggctgaagcgcatggccatctccggcgacgactgcgtggtgaagcccatcgacgaccggttcgccaacgccctgctcgcgctgaacgacatggggaaggtccgcaaggacatcccccagtggcagcccagcaagggctggcacgactggcagcaggtcccgttctgctcccaccacttccacgagctgatcatgaaggacgggcggaagctcgtggtcccctgccgcccccaggacgagctgatcggccgggcccgcatcagccagggggccggctggtccctgcgcgagacggcctgcctcggcaaggcgtacgcccagatgtggagcctgatgtacttccaccggcgcgacctgcggctcgcctccaacgccatctgcagcgccgtgcccgtgcactgggtcccgacctcccgcaccacctggagcatccacgcgcaccaccagtggatgacgaccgaggacatgctgaccgtgtggaaccgggtgtggatcgaggacaacccctggatggaggacaagacccccgtcacgacctgggagaacgtgccctacctggggaagcgcgaggaccagtggtgcggcagcctcatcgggctgacctcccgggccacctgggcccagaacatcccgacggccatccagcaggtccgcagcctgatcggcaacgaggagttcctcgactacatgccctccatgaagcggttccgcaaggaggaggagagcgagggggccatctggtga

SEQ ID NO: 9828 - RNA, 9873 nt, synthetic construct
  misc_feature 1..9873: note = derived and/or modified CDS sequence (opt1) from DENV-3__JX669500__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccggagcacgacccgcatggagaacctgctgtggaagcagatcgccaacgagctcaactacatcctgtgggagaacaacatcaagctgaccgtggtggtcggggacatcatcggcgtgctcgagcagggcaagcggaccctgacgccccagccgatggagctgaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccgcccgggctaccacacccagaccgccgggccctggcacctcggcaagctggagctggacttcaactactgcgagggcacgaccgtggtcatcaccgagaactgcgggacccggggccccagcctccgcacgaccaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtctccgccggcagcgggaaggtggacaacttcacgatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacaccctgatcatgatcggcagcaacgcctccgaccgcatggggatgggcgtcacgtacctcgccctgatcgcgaccttcaagatccagcccttcctggccctcgggttcttcctgcggaagctgaccagccgcgagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcggacggcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacaccctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcggatcaaggacgacgagaccgagaacatcctcaccgtgctgctgaagacggccctcctgatcgtctccggcgtgttcccgtacagcatccccgcgaccctgctcgtgtggcacacctggcagaagcagacccagcgctccggcgtcctgtgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctcacgtacaacgggaagcggctggagcccaactgggcctccgtcaagaaggacctgatcagctacggcgggggctggcgcctctccgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctcaccatcatggacctgcaccccgggagcggcaagacccggaagtacctgccggccatcgtccgcgaggccatcaagcggcgcctccggacgctgatcctggcccccacccgcgtggtggccgcggagatggaggaggccctcaaggggctgcccatccggtaccagaccaccgccacgaagtccgagcacaccggccgcgagatcgtcgacctgatgtgccacgccaccttcaccatgcggctcctgagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctccgcaagaacgggaagaaggtcatccagctgtcccggaagaccttcgacacggagtaccagaagaccaagctgaacgactgggacttcgtggtgaccaccgacatcagcgagatgggcgccaacttcaaggcggaccgcgtcatcgacccgcggcgctgcctcaagcccgtgatcctgacggacggccccgagcgggtgatcctggccgggcccatgccggtcaccgccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagacgttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacctactccgacccgctggcgctcaaggagttcaaggacttcgccgccggccgcaagagcatcgccctggacctggtgacggagatcgggcgcgtgccctcccacctcgcccaccggacccgcaacgcgctggacaacctggtcatgctccacaccagcgagcacggcgggcgggcctaccgccacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcacgctggccgcgatcatcgccgccaacgagatgggcctgctcgagaccaccaagcgcgacctgggcatgtccaaggagccgggggtggtgagccccacctcctacctggacgtcgacctccaccccgccagcgcgtggacgctgtacgccgtggccaccaccgtgatcacccccatgctgcggcacacgatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacgcactacgccatcatcggccccggcctccaggccaaggccacccgcgaggcccagaagcggaccgcggccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcgcaccagctgggccctctgcgaggcgctgaccctggccaccggccccatcacgaccctctgggagggctcccccgggaagttctggaacaccaccatcgccgtgagcatggccaacatcttccggggctcctacctggccggggcgggcctggccttcagcatcatgaagtccgtcgggacgggcaagcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagatcacgcaccacgccgtgagccgcggctccgccaagctgcagtggttcgtcgagcggaacatggtgatcccggaggggcgcgtgatcgacctcggctgcgggcggggcgggtggagctactactgcgcgggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctgaccaagccctgggacgtcgtgcccatggtgacccagatggccatgacggacaccacccccttcgggcagcagcgggtcttcaaggagaaggtggacacccgcacgccgcggcccatgcccggcacccgccgggtgatgggcatcaccgccgagtggctctggcgcaccctggggcggaacaagaagccccgcctgtgcacgcgcgaggagttcaccaagaaggtccggaccaacgcggccatgggcgccgtgttcaccgaggagaaccagtgggacagcgccaaggccgcggtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccggcggggcgatgtacgccgacgacacggccgggtgggacacccggatcaccgaggacgacctgcacaacgaggagaagatcacccagcagatggaccccgagcaccgccagctcgccaacgccatcttcaagctgacgtaccagaacaaggtcgtgaaggtgcagcggcccacccccaccgggaccgtcatggacatcatctcccgcaaggaccagcggggcagcggccaggtgggcacctacgggctgaacacgttcaccaacatggaggcgcagctcatccgccagatggagggcgagggggtgctgtccaaggccgacctggagaacccgcacctccccgagaagaagatcacccagtggctggagaccaagggcgtcgagcggctgaagcgcatggccatcagcggcgacgactgcgtggtgaagcccatcgacgaccggttcgccaacgccctcctggcgctgaacgacatggggaaggtccgcaaggacatcccccagtggcagccgtccaagggctggcacgactggcagcaggtccccttctgcagccaccacttccacgagctcatcatgaaggacgggcggaagctggtggtcccctgccgcccccaggacgagctgatcggccgggcccgcatctcccagggggccggctggagcctccgcgagacggcctgcctgggcaaggcgtacgcccagatgtggtccctgatgtacttccaccggcgcgacctccggctggccagcaacgccatctgctccgccgtgccggtgcactgggtccccaccagccgcaccacctggtccatccacgcgcaccaccagtggatgacgaccgaggacatgctgaccgtgtggaaccgggtgtggatcgaggacaacccctggatggaggacaagacccccgtcacgacctgggagaacgtgccgtacctcgggaagcgcgaggaccagtggtgcggcagcctgatcgggctgaccagccgggccacctgggcccagaacatccccacggccatccagcaggtccgctccctcatcggcaacgaggagttcctggactacatgcccagcatgaagcggttccgcaaggaggaggagtccgagggggccatctggtga

SEQ ID NO: 9829 - RNA, 9873 nt, synthetic construct
  misc_feature 1..9873: note = derived and/or modified CDS sequence (opt1) from DENV-3__JX669497__SS-prME
  source 1..9873: mol_type = other RNA
accagcctgtgcctcatgatgatcctgcccgccgccctggcgttccacctcaccagccgcgacggggagccgcggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagagcaacatcgtcatcggcatcggggacaacgcgtccaagatcaactggtacaagaagggcagctccatcgggaagatgttcgaggccaccgcccgcggcgcccggcgcatggccatcctgggcgacaccgcgtgggacttcgggagcgtgggcggggtgctgaactccctcggcaagatggtccaccagatcttcgggagcgcctacacggccctgttctccggcgtgagctgggtgatgaagatcggcatcggggtcctgctcacctggatcggcctgaactccaagaacaccagcatgtccttcagctgcatcgccatcgggatcatcaccctgtacctcggcgccgtggtgcaggcggacatggggtgcgtcatcaactggaagggcaaggagctgaagtgcggctccgggatcttcgtgacgaacgaggtgcacacctggaccgagcagtacaagttccaggccgacagccccaagcgcctggccaccgccatcgccggcgcgtgggagaacggggtctgcggcatccggtccacgacccgcatggagaacctcctgtggaagcagatcgccaacgagctgaactacatcctctgggagaacaacatcaagctgaccgtggtggtcggggacatcatcggcgtgctggagcagggcaagcggaccctcacgccccagccgatggagctgaagtacagctggaagacctgggggaaggccaagatcgtgaccgccgagacccagaactccagcttcatcatcgacggccccaacacgcccgagtgcccctccgcgagccgcgcctggaacgtctgggaggtggaggactacgggttcggcgtgttcaccaccaacatctggctgaagctccgggaggtctacacccagctgtgcgaccaccgcctgatgagcgccgccgtgaaggacgagcgggccgtgcacgcggacatgggctactggatcgagtcccagaagaacgggagctggaagctcgagaaggcctccctgatcgaggtcaagacctgcacgtggcccaagtcccacaccctgtggtccaacggcgtgctcgagagcgacatgatcatccccaagtccctggccgggcccatcagccagcacaaccaccgcccgggctaccacacccagaccgccgggccctggcacctgggcaagctcgagctggacttcaactactgcgagggcacgaccgtggtcatcaccgagaactgcgggacccggggcccctccctgcgcacgaccaccgtgagcgggaagctcatccacgagtggtgctgccggtcctgcaccctgcccccgctgcgctacatgggcgaggacgggtgctggtacggcatggagatccggcccatcagcgagaaggaggagaacatggtgaagtccctcgtcagcgccggctccgggaaggtggacaacttcacgatgggcgtgctgtgcctggcgatcctcttcgaggaggtcatgcgcgggaagttcggcaagaagcacatgatcgccggggtgttcttcaccttcgtgctgctgctcagcggccagatcacctggcgggacatggcccacaccctgatcatgatcggctccaacgccagcgaccgcatggggatgggcgtcacgtacctggccctcatcgcgaccttcaagatccagcccttcctggccctggggttcttcctccggaagctgaccagccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatctccctgacgtgcagcaacaccatgttcaccctcaccgtggcctggcggacggcgaccctgatcctggccggggtctccctcctgccggtgtgccagagctccagcatgcgcaagaccgactggctgcccatggccgtcgccgccatgggcgtgccgcccctgccgctgttcatcttctccctgaaggacaccctcaagcgccggagctggcccctgaacgagggggtgatggcggtcggcctggtgtccatcctcgccagctccctgctgcgcaacgacgtgcccatggccggccccctcgtcgccgggggcctgctgatcgcctgctacgtgatcacggggaccagcgcggacctcaccgtggagaaggccgccgacatcacctgggaggaggaggccgagcagacgggcgtctcccacaacctgatgatcaccgtggacgacgacgggaccatgcggatcaaggacgacgagaccgagaacatcctgaccgtgctcctgaagacggccctgctcatcgtcagcggcgtgttcccgtactccatccccgcgaccctgctggtgtggcacacctggcagaagcagacccagcgcagcggcgtcctctgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggccagcgtcaagaaggacctgatctcctacggcgggggctggcgcctgagcgcgcagtggcagaagggggaggaggtccaggtgatcgccgtcgagcccggcaagaaccccaagaacttccagaccatgcccggcaccttccagaccacgaccggggagatcggcgccatcgccctcgacttcaagcccgggaccagcggctcccccatcatcaaccgggagggcaaggtggtggggctgtacggcaacggggtcgtgaccaagaacggcgggtacgtgagcggcatcgcccagacgaacgcggagccggacggccccacccccgagctggaggaggagatgttcaagaagcgcaacctgaccatcatggacctccaccccgggtccggcaagacccggaagtacctgccggccatcgtccgcgaggccatcaagcggcgcctgcggacgctcatcctggcccccacccgcgtggtggccgcggagatggaggaggccctgaaggggctccccatccggtaccagaccaccgccaccaagagcgagcacaccggccgcgagatcgtcgacctgatgtgccacgccaccttcaccatgcggctgctctcccccgtgcgcgtgccgaactacaacctgatcatcatggacgaggcccacttcacggaccccgcgagcatcgccgcccgggggtacatctccacccgcgtcggcatgggcgaggccgcggccatcttcatgaccgccacgccgcccgggacggccgacgccttcccgcagagcaacgcgcccatccaggacgaggagcgcgacatccccgagcggtcctggaacagcggcaacgagtggatcaccgacttcgccgggaagaccgtgtggttcgtgccctccatcaaggccggcaacgacatcgccaactgcctgcgcaagaacgggaagaaggtcatccagctcagccggaagaccttcgacacggagtaccagaagaccaagctgaacgactgggacttcgtggtgaccaccgacatctccgagatgggcgccaacttcaaggcggaccgcgtcatcgacccgcggcgctgcctgaagcccgtgatcctcacggacggccccgagcgggtgatcctggccgggcccatgccggtcaccgccgccagcgccgcgcagcgccggggccgcgtggggcggaacccccagaaggagaacgaccagtacatcttcaccggccagcccctgaacaacgacgaggaccacgcccactggaccgaggccaagatgctcctggacaacatcaacacccccgaggggatcatcccggccctgttcgagcccgagcgcgagaagtccgcggccatcgacggcgagtaccggctcaagggcgagagccgcaagacgttcgtggagctgatgcggcgcggggacctgcccgtctggctcgcccacaaggtggcctccgagggcatcaagtacaccgaccggaagtggtgcttcgacgggcagcgcaacaaccagatcctggaggagaacatggacgtcgagatctggaccaaggagggcgagaagaagaagctgcggccccgctggctcgacgcccgcacctacagcgacccgctggcgctgaaggagttcaaggacttcgccgccggccggaagtccatcgccctcgacctggtgacggagatcgggcgcgtgcccagccacctggcccaccggacccgcaacgcgctcgacaacctggtcatgctgcacaccagcgagcacggcgggcgggcctaccgccacgccgtggaggagctccccgagaccatggagacgctgctgctcctgggcctgatgatcctcctgaccgggggcgccatgctgttcctcatctccggcaaggggatcggcaagaccagcatcgggctgatctgcgtgatcgcctccagcggcatgctgtggatggcggagatcccgctccagtggatcgcctccgccatcgtcctggagttcttcatgatggtgctgctcatccccgagcccgagaagcagcggacgccccaggacaaccagctggcctacgtggtcatcgggatcctgacgctcgccgcgatcatcgccgccaacgagatgggcctgctggagaccaccaagcgcgacctcggcatgagcaaggagccgggggtggtgtcccccaccagctacctggacgtcgacctgcaccccgcctccgcgtggacgctctacgccgtggccaccaccgtgatcacccccatgctgcggcacacgatcgagaacagcaccgccaacgtctccctggccgcgatcgccaaccaggccgtggtgctcatgggcctggacaaggggtggccgatcagcaagatggacctgggcgtccccctcctggccctggggtgctactcccaggtgaaccccctcaccctgaccgccgcggtgctgctcctgatcacgcactacgccatcatcggccccggcctgcaggccaaggccacccgcgaggcccagaagcggaccgcggccgggatcatgaagaacccgaccgtcgacggcatcatgacgatcgacctcgaccccgtgatctacgacagcaagttcgagaagcagctgggccaggtgatgctgctcgtcctgtgcgccgtgcagctgctcctgatgcgcacctcctgggccctgtgcgaggcgctcaccctggccaccggccccatcacgaccctgtgggagggcagccccgggaagttctggaacaccaccatcgccgtgtccatggccaacatcttccggggcagctacctcgccggggcgggcctggccttctccatcatgaagtccgtcgggacgggcaagcgcggcaccgggagccagggcgagaccctgggggagaagtggaagaagaagctcaaccagctgtcccggaaggagttcgacctgtacaagaagtccggcatcaccgaggtggaccgcaccgaggccaaggaggggctcaagcggggcgagatcacgcaccacgccgtgtcccgcggcagcgccaagctgcagtggttcgtcgagcggaacatggtgatcccggaggggcgcgtgatcgacctgggctgcgggcggggcgggtggtcctactactgcgcgggcctcaagaaggtcaccgaggtgcgcggctacaccaagggcgggcccgggcacgaggagcccgtgcccatgagcacctacggctggaacatcgtcaagctgatgtccgggaaggacgtgttctacctgccgcccgagaagtgcgacacgctcctgtgcgacatcggcgagagctcccccagccccaccgtggaggagtcccgcaccatccgggtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgagccggaactccacgcacgagatgtactggatcagcaacggcaccgggaacatcgtggcctccgtcaacatggtgagccgcctgctcctgaaccggttcaccatgacccaccgccggccgacgatcgagaaggacgtggacctgggcgccggcacccgccacgtcaacgccgagcccgagacccccaacatggacgtgatcggggagcggatcaagcgcatcaaggaggagcacaactccacctggcactacgacgacgagaacccgtacaagacgtgggcctaccacggcagctacgaggtgaaggcgaccgggtccgccagcagcatgatcaacggcgtcgtgaagctcctgaccaagccctgggacgtcgtgcccatggtgacccagatggccatgacggacaccacccccttcgggcagcagcgggtcttcaaggagaaggtggacacccgcacgccgcggtccatgcccggcacccgccgggtgatgggcatcaccgccgagtggctgtggcgcaccctcgggcggaacaagaagccccgcctgtgcacgcgcgaggagttcaccaagaaggtccggaccaacgcggccatgggcgccgtgttcaccgaggagaaccagtgggacagcgccaaggccgcggtggaggacgaggacttctggaagctggtcgaccgcgagcgggagctccacaagctggggaagtgcggctcctgcgtgtacaacatgatggggaagcgcgagaagaagctgggcgagttcggcaaggccaaggggagccgggccatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccgggggcgcgatgtacgccgacgacacggccgggtgggacacccggatcaccgaggacgacctgcacaacgaggagaagatcacccagcagatggacccggagcaccgccagctggccaacgccatcttcaagctcacgtaccagaacaaggtcgtgaaggtgcagcggcccacccccaccggcaccgtcatggacatcatctcccgcaaggaccagcggggcagcggccaggtgggcacctacgggctgaacacgttcaccaacatggaggcgcagctgatccgccagatggagggcgagggggtgctctccaaggccgacctggagaacccccacctcccggagaagaagatcacccagtggctcgagaccaagggcgtcgagcggctgaagcgcatggccatcagcggcgacgactgcgtggtgaagcccatcgacgaccggttcgccaacgccctgctcgcgctgaacgacatggggaaggtccgcaaggacatcccccagtggcagccctccaagggctggcacgactggcagcaggtcccgttctgcagccaccacttccacgagctgatcatgaaggacgggcggaagctcgtggtcccctgccgcccccaggacgagctgatcggccgggcccgcatctcccagggggccggctggagcctgcgcgagacggcctgcctcggcaaggcgtacgcccagatgtggtccctgatgtacttccaccggcgcgacctgcggctcgccagcaacgccatctgctccgccgtgcccgtgcactgggtcccgaccagccgcaccacctggagcatccacgcgcaccaccagtggatgacgaccgaggacatgctgaccgtgtggaaccgggtgtggatcgaggacaacccctggatggaggacaagacccccgtcacgacctgggagaacgtgccctacctggggaagcgcgaggaccagtggtgcggctccctcatcgggctgaccagccgggccacctgggcccagaacatcccgacggccatccagcaggtccgctccctgatcggcaacgaggagttcctcgactacatgcccagcatgaagcggttccgcaaggaggaggagtccgagggggccatctggtga

SEQ ID NO: 9830 - RNA, 9873 nt, synthetic construct
  misc_feature 1..9873: note = derived and/or modified CDS sequence (opt1) from DENV-3__JX669501__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtaccggggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcgtgaactggaagggcaaggagctgaagtgcggcagcgggatcttcgtgacgaacgaggtccacacctggaccgagcagtacaagttccaggccgactcccccaagcggctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgcgatcctgttcgaggaggtgatgcgggggaagttcggcaagaagcacatgatcgccggggtgttcttcaccttcgtcctgctcctgtccggccagatcacctggcgcgacatggcccacaccctgacgatgatcggcagcaacgcctccgaccggatggggatgggcgtgacctacctcgccctgatcgcgaccttcaagatccagcccttcctggccctcgggttcttcctgcgcaagctgaccagccgggagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatgttcaccctgacggtcgcctggcgcaccgcgaccctgatcctcgccggggtgagcctgctgccggtctgccagtccagctccatgcgcaagaccgactggctccccatggccgtggccgccatgggcgtgccgcccctcccgctgttcatcttcagcctcaaggacacgctgaagcggcgctcctggcccctgaacgagggggtcatggcggtgggcctcgtgagcatcctggcctccagcctgctccggaacgacgtccccatggccggccccctggtggccgggggcctgctcatcgcctgctacgtgatcaccgggacctccgcggacctgaccgtcgagaaggccgccgacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcgtgttcccgtacagcatccccgcgaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgccgtcctcacctacaacgggaagcgcctggagcccaactgggcctccgtgaagaaggacctgatcagctacggcgggggctggcggctctccgcgcagtggcagaagggggaggaggtgcaggtcatcgccgtggagcccggcaagaaccccaagaacttccagaccatgcccggcaccttccagacgaccaccggggagatcggcgccatcgccctggacttcaagcccgggaccagcggcagccccatcatcaaccgcgagggcaaggtggtcgggctgtacggcaacggggtggtgacgaagaacggcgggtacgtctccggcatcgcccagaccaacgcggagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcccccacccgggtggtcgccgcggagatggaggaggccctcaaggggctgcccatccgctaccagaccacggccaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcgtccatcgccgcccgcgggtacatcagcacccgcgtgggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcaccgacttcgccgggaagaccgtgtggttcgtccccagcatcaaggccggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggcggaccgggtgatcgacccgcgccggtgcctcaagcccgtgatcctgaccgacggccccgagcgcgtcatcctggccgggcccatgccggtgaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgcggccatcgacggcgagtaccgcctgaagggcgagtcccggaagaccttcgtcgagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccgctggctggacgcccggacgtactccgacccgctggcgctcaaggagttcaaggacttcgccgccggccgcaagagcatcgccctggacctggtgaccgagatcgggcgggtcccctcccacctcgcccaccgcacccggaacgcgctggacaacctggtgatgctccacaccagcgagcacggcgggcgcgcctaccggcacgccatggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcgcacgccccaggacaaccagctggcctacgtggtcatcgggatcctcaccctggccgcgatcatcgccgccaacgagatgggcctgctcgagaccaccaagcgggacctgggcatgtccaaggagccgggggtggtgagccccacgtcctacctggacgtcgacctccaccccgccagcgcgtggaccctgtacgccgtggccaccaccgtgatcacgcccatgctgcgccacaccatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgacggccgcggtgctcctgctgatcacccactacgccatcatcggccccggcctccaggccaaggccacccgggaggcccagaagcgcaccgcggccgggatcatgaagaacccgacggtcgacggcatcatgaccatcgacctggaccccgtgatgtacgactccaagttcgagaagcagctgggccaggtgatgctcctggtcctgtgcgccgtgcagctcctgctgatgcggaccagctgggccctctgcgaggcgctgaccctggccacgggccccatcaccaccctctgggagggctcccccgggaagttctggaacaccacgatcgccgtgagcatggccaacatcttccgcggctcctacctggccggggcgggcctggccttcagcatcatgaagtccgtcgggaccggcaagcggggcaccgggagccagggcgagaccctcggggagaagtggaagaagaagctgaaccagctgagccgcaaggagttcgacctctacaagaagtccggcatcaccgaggtggaccggacggaggccaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccggaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgccggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggcgaccgggagcgcctccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccgcctgtgcacccgggaggagttcaccaagaaggtccgcaccaacgcggccatgggcgccgtgttcacggaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcgcagctcatccggcagatggagggcgagggggtgctgagcaaggccgacctggagaacccccacctcccggagaagaagatcacccagtggctggagacgaagggcgtcgagcgcctgaagcggatggccatctccggcgacgactgcgtggtgaagcccatcgacgaccgcttcgccaacgccctcctggcgctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccgcatcagccagggggccggctggtccctccgggagaccgcctgcctgggcaaggcgtacgcccagatgtggagcctgatgtacttccaccgccgggacctccgcctggcctccaacgccatctgcagcgccgtgcccgtgcactgggtcccgacctcccggaccacgtggagcatccacgcgcaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgacctcccgcgccacgtgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 9831 - RNA, 9873 nt, synthetic construct
  misc_feature 1..9873: note = derived and/or modified CDS sequence (opt1) from DENV-3__JX669494__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagaccgcctccgggaccaacatgtgcaccctcatcgccatggacctgggggagatgtgcgacgacaccgtgacctacaagtgcccccacatcaccgaggtggagcccgaggacatcgactgctggtgcaacctgaccagcacctgggtgacgtacgggacctgcaaccaggccggcgagcggcgccgggacaagcgctccgtggccctcgcgccccacgtgggcatggggctggacacccggacccagacgtggatgagcgccgagggcgcctggcgccaggtggagaaggtggagacctgggccctgcggcacccggggttcaccatcctcgcgctgttcctggcccactacatcggcacctccctcacgcagaaggtggtgatcttcatcctgctgatgctcgtgacccccagcatgaccatgcgctgcgtgggggtgggcaaccgggacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccgcaagctgtgcatcgagggcaagatcaccaacatcaccacggacagccggtgccccacccagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcggacgggcctggacttcaacgagatgatcctgctcaccatgaagaacaaggcctggatggtgcaccgccagtggttcttcgacctgcccctgccctggaccagcggcgccaccacggagacccccacctggaaccggaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtcctgaagaaggaggtgtccgagacccagcacgggaccatcctcatcaaggtggagtaccggggcgaggacgcgccgtgcaagatccccttcagcacggaggacgggcagggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcggctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgctgttcaccttcgtgctcctgctgtccggccagatcacctggcgcgacatggcccacacgctcatcatgatcggcagcaacgcctccgaccggatggggatgggcgtcacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatgttcaccctgacggtggcctggcgcaccgcgaccctcatcctggccggggtcagcctgctcccggtgtgccagtccagctccatgcgcaagaccgactggctgcccatggccgtcgccgccatgggcgtgccgcccctgcccctgttcatcttcagcctgaaggacacgctgaagcggcgctcctggcccctcaacgagggggtgatggcggtcggcctggtgagcatcctggcctccagcctcctgcggaacgacgtgcccatggccggccccctggtcgccgggggcctcctgatcgcctgctacgtgatcaccgggacctccgcggacctgaccgtggagaaggccgccgacatcacgtgggaggaggaggccgagcagaccggcgtcagccacaacctcatgatcaccgtggacgacgacgggaccatgcgcatcaaggacgacgagaccgagaacatcctgacggtgctgctcaagaccgccctgctgatcgtctccggcgtgttcccgtacagcatccccgcgaccctcctggtgtggcacacctggcagaagcagacgcagcggtccggcgtcctgtgggacgtgcccagcccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacctacaacgggaagcgcctggagcccaactgggcctccgtcaagaaggacctcatcagctacggcgggggctggcggctgtccgcgcagtggcagaagggggaggaggtccaggtgatcgccgtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgcggagccggacggccccacccccgagctcgaggaggagatgttcaagaagcggaacctgaccatcatggacctgcaccccgggagcggcaagacgcgcaagtacctcccggccatcgtccgggaggccatcaagcgccggctgcgcaccctgatcctcgcccccacccgggtggtggccgcggagatggaggaggccctgaaggggctgcccatccgctaccagaccacggccaccaagtccgagcacaccggccgggagatcgtcgacctcatgtgccacgccaccttcacgatgcgcctgctgagccccgtgcgggtgccgaactacaacctcatcatcatggacgaggcccacttcaccgaccccgcgtccatcgccgcccgcgggtacatcagcacccgcgtcggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcaccgacttcgccgggaagaccgtgtggttcgtgcccagcatcaaggccggcaacgacatcgccaactgcctgcggaagaacgggaagaaggtcatccagctgtcccgcaagacgttcgacaccgagtaccagaagaccaagctcaacgactgggacttcgtggtgaccacggacatcagcgagatgggcgccaacttcaaggcggaccgggtcatcgacccgcgccggtgcctgaagcccgtgatcctgaccgacggccccgagcgcgtgatcctcgccgggcccatgccggtcaccgccgcctccgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacacgcccgaggggatcatcccggccctgttcgagcccgagcgggagaagtccgcggccatcgacggcgagtaccgcctgaagggcgagtcccggaagaccttcgtggagctcatgcgccgcggggacctgcccgtctggctggcccacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccgctggctggacgcccggacgtactccgacccgctcgcgctgaaggagttcaaggacttcgccgccggccgcaagagcatcgccctggacctcgtgaccgagatcgggcgggtgccctcccacctggcccaccgcacccggaacgcgctggacaacctcgtcatgctgcacaccagcgagcacggcgggcgcgcctaccggcacgccgtggaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggcggagatcccgctgcagtggatcgccagcgccatcgtcctcgagttcttcatgatggtgctgctgatccccgagcccgagaagcagcgcacgccccaggacaaccagctcgcctacgtggtcatcgggatcctgaccctggccgcgatcatcgccgccaacgagatgggcctcctggagaccaccaagcgggacctgggcatgtccaaggagccgggggtggtgagccccacgtcctacctcgacgtcgacctgcaccccgccagcgcgtggaccctgtacgccgtggccaccaccgtgatcacgcccatgctccgccacaccatcgagaactccaccgccaacgtcagcctggccgcgatcgccaaccaggccgtggtgctgatgggcctcgacaaggggtggccgatctccaagatggacctgggcgtccccctgctcgccctggggtgctacagccaggtgaaccccctgaccctcacggccgcggtgctgctgctcatcacccactacgccatcatcggccccggcctgcaggccaaggccacccgggaggcccagaagcgcaccgcggccgggatcatgaagaacccgacggtcgacggcatcatgaccatcgacctggaccccgtgatctacgactccaagttcgagaagcagctcggccaggtgatgctgctggtcctctgcgccgtgcagctgctgctcatgcggaccagctgggccctgtgcgaggcgctgaccctcgccacgggccccatcaccaccctgtgggagggctcccccgggaagttctggaacaccacgatcgccgtgagcatggccaacatcttccgcggctcctacctggccggggcgggcctcgccttcagcatcatgaagtccgtcgggaccggcaagcggggcaccgggagccagggcgagaccctgggggagaagtggaagaagaagctgaaccagctcagccgcaaggagttcgacctgtacaagaagtccggcatcaccgaggtggaccggacggaggccaaggaggggctgaagcgcggcgagatcacccaccacgccgtgagccggggctccgccaagctccagtggttcgtcgagcgcaacatggtgatcccggaggggcgggtgatcgacctgggctgcgggcgcggcgggtggagctactactgcgcgggcctgaagaaggtcaccgaggtgcgcggctacaccaagggcgggcccgggcacgaggagcccgtgcccatgtccacgtacggctggaacatcgtcaagctcatgagcgggaaggacgtgttctacctgccgcccgagaagtgcgacaccctgctgtgcgacatcggcgagtccagcccctcccccaccgtggaggagagccggaccatccgcgtcctcaagatggtggagccgtggctgaagaacaaccagttctgcatcaaggtgctgaacccctacatgcccacggtcatcgagcacctcgagcggctgcagcgcaagcacggcgggatgctggtgcggaaccccctctcccgcaacagcacccacgagatgtactggatctccaacggcaccgggaacatcgtggccagcgtcaacaccgtgtcccggctgctgctcaaccgcttcacgatgacccaccggcgcccgaccaccgagaaggacgtggacctgggcgccggcacgcggcacgtcaacgccgagcccgagacccccaacatggacgtgatcggggagcgcatcaagcggatcaaggaggagcacaacagcacctggcactacgacgacgagaacccgtacaagacctgggcctaccacggctcctacgaggtgaaggcgacggggagcgcctccagcatgatcaacggcgtcgtgaagctgctcaccaagccctgggacgtcgtgcccatggtgacccagatggccatgaccgacacgacccccttcgggcagcagcgcgtcttcaaggagaaggtggacacccggaccccgcgcagcatgcccggcacgcggcgcgtgatgggcatcaccgccgagtggctgtggcggaccctggggcgcaacaagaagccccgcctctgcacccgggaggagttcacgaagaaggtccgcaccaacgcggccatgggcgccgtgttcaccgaggagaaccagtgggactccgccaaggccgcggtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgccatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgcgatgtacgccgacgacaccgccgggtgggacacgcgcatcaccgaggacgacctccacaacgaggagaagatcacccagcagatggacccggagcaccggcagctggccaacgccatcttcaagctgacctaccagaacaaggtcgtgaaggtgcagcgccccacccccacgggcaccgtcatggacatcatcagccggaaggaccagcgcggctccggccaggtgggcacctacgggctcaacaccttcacgaacatggaggcgcagctgatccggcagatggagggcgagggggtgctgagcaaggccgacctcgagaacccccacctcccggagaagaagatcacccagtggctggagaccaagggcgtcgagcgcctcaagcggatggccatctccggcgacgactgcgtggtgaagcccatcgacgaccgcttcgccaacgccctgctggcgctcaacgacatggggaaggtccggaaggacatcccccagtggcagcccagcaagggctggcacgactggcagcaggtcccgttctgctcccaccacttccacgagctgatcatgaaggacgggcgcaagctggtggtcccctgccggccccaggacgagctcatcggccgcgcccgcatcagccagggggccggctggtccctgcgggagaccgcctgcctgggcaaggcgtacgcccagatgtggagcctcatgtacttccaccgccgggacctgcgcctggcctccaacgccatctgcagcgccgtgcccgtgcactgggtcccgacgtcccggaccacctggagcatccacgcgcaccaccagtggatgaccacggaggacatgctcaccgtgtggaaccgcgtgtggatcgaggacaacccctggatggaggacaagacccccgtcaccacgtgggagaacgtgccctacctggggaagcgggaggaccagtggtgcggcagcctgatcgggctcacctcccgcgccacctgggcccagaacatcccgaccgccatccagcaggtccggagcctgatcggcaacgaggagttcctggactacatgccctccatgaagcgcttccggaaggaggaggagagcgagggggccatctggtga

SEQ ID NO: 9832 - RNA, 9873 nt, synthetic construct
  misc_feature 1..9873: note = derived and/or modified CDS sequence (opt1) from DENV-3__JX669503__SS-prME
  source 1..9873: mol_type = other RNA
accagcttctgcctgatgatgatcctccccgcggccctggcgttccacctgaccagccgggacggggagccgcggatgatcgtggggaagaacgagcgcggcaagagcctcctgttcaagaccgcctccgggatcaacatgtgcaccctgatcgccatggacctcggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctggcgccccacgtgggcatggggctcgacacccggacccagacctggatgagcgccgagggcgcctggcgccaggtggagaaggtggagacgtgggccctgcggcacccggggttcaccatcctggccctcttcctggcccactacatcggcacctccctgacccagaaggtggtgatcttcatcctcctgatgctggtcacgcccagcatgaccatgcgctgcgtgggggtgggcaaccgggacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcgcaagctctgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctgttcgggaagggctccctcgtgacctgcgccaagttccagtgcctggagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctccccgagtacggcaccctggggctggagtgctccccgcggaccggcctcgacttcaacgagatgatcctgctgacgatgaagaacaaggcctggatggtgcaccgccagtggttcttcgacctccccctgccctggaccagcggcgccaccaccgagacgcccacctggaaccggaaggagctgctcgtgaccttcaagaacgcccacgccaagaagcaggaggtcgtggtgctggggtcccaggagggcgcgatgcacaccgccctgacgggggccaccgagatccagaacagcggcgggacctccatcttcgccggccacctcaagtgccgcctgaagatggacaagctggagctcaagggcatgagctacgccatgtgcaccaacacgttcgtcctgaagaaggaggtgtccgagacccagcacgggaccatcctgatcaaggtggagtacaagggcgaggacgcgccgtgcaagatccccttcagcaccgaggacgggcagggcaaggcccacaacggccggctcatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctgaacagcctcggcaagatggtccaccagatcttcgggtccgcctacacggccctgttcagcggcgtgtcctgggtgatgaagatcggcatcggggtcctgctcacctggatcggcctgaacagcaagaacacctccatgagcttctcctgcatcgccatcgggatcatcaccctgtacctcggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctggccaccgccatcgccggcgcgtgggagaacggggtctgcggcatccggagcacgacccgcatggagaacctcctgtggaagcagatcgccaacgagctgaactacatcctctgggagaacaacatcaagctgaccgtggtggtcggggacatcatcggcgtgctggagcagggcaagcggaccctcacgccccagccgatggagctgaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctgaagctccgggaggtctacacccagctgtgcgaccaccgcctgatgagcgccgccgtgaaggacgagcgggccgtgcacgcggacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggccgggcccatctcccagcacaaccaccgcccgggctaccacacccagaccgccgggccctggcacctgggcaagctcgagctggacttcaactactgcgagggcacgaccgtggtcatcaccgagaactgcgggacccggggccccagcctgcgcacgaccaccgtgtccgggaagctcatccacgagtggtgctgccggagctgcaccctgcccccgctgcgctacatgggcgaggacgggtgctggtacggcatggagatccggcccatctccgagaaggaggagaacatggtcaagagcctcgtctccgccggcagcgggaaggtggacaacttcacgatgggcgtgctgtgcctggcgatcctcttcgaggaggtcatgcgcgggaagttcggcaagaagcacatgatcgccggggtgttcttcaccttcgtgctgctgctctccggccagatcacctggcgggacatggcccacaccctgatcatgatcggcagcaacgcctccgaccgcatggggatgggcgtcacgtacctggccctcatcgcgaccttcaagatccagcccttcctggccctggggttcttcctccggaagctgaccagccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatcagcctgacgtgctccaacaccatgttcaccctcaccgtggcctggcggacggcgaccctgatcctggccggggtcagcctcctgccggtgtgccagtccagctccatgcgcaagaccgactggctgcccatggccgtcgccgccatgggcgtgccgcccctcccgctgttcatcttcagcctgaaggacaccctcaagcgccggtcctggcccctgaacgagggggtgatggcggtcggcctggtgagcatcctcgcctccagcctgctgcgcaacgacgtgcccatggccggccccctcgtcgccgggggcctgctgatcgcctgctacgtgatcacggggacctccgcggacctcaccgtggagaaggccgccgacatcacctgggaggaggaggccgagcagacgggcgtcagccacaacctgatgatcaccgtggacgacgacgggaccatgcggatcaaggacgacgagaccgagaacatcctgaccgtgctcctgaagacggccctgctcatcgtctccggcgtgttcccgtacagcatccccgcgaccctgctggtgtggcacacctggcagaagcagacccagcgctccggcgtcctctgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggcctccgtcaagaaggacctgatcagctacggcgggggctggcgcctgtccgcgcagtggcagaagggggaggaggtccaggtgatcgccgtcgagcccggcaagaaccccaagaacttccagaccatgcccggcaccttccagaccacgaccggggagatcggcgccatcgccctcgacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctgaccatcatggacctccaccccgggagcggcaagacccggaagtacctgccggccatcgtccgcgaggccatcaagcggcgcctgcggacgctcatcctggcccccacccgcgtggtggccgcggagatggaggaggccctgaaggggctccccatccggtaccagaccaccgccacgaagtccgagcacaccggccgcgagatcgtcgacctgatgtgccacgccaccttcaccatgcggctgctcagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctctcccggaagaccttcgacacggagtaccagaagaccaagctgaacgactgggacttcgtggtgaccaccgacatcagcgagatgggcgccaacttcaaggcggaccgcgtcatcgacccgcggcgctgcctgaagcccgtgatcctcacggacggccccgagcgggtggtcctggccgggcccatgccggtgaccgccgcctccgccgcgcagcgccggggccgcgtggggcggaacccccagaaggagaacgaccagtacatcttcaccggccagcccctgaacaacgacgaggaccacgcccactggaccgaggccaagatgctcctggacaacatcaacacccccgaggggatcatcccggccctgttcgagcccgagcgcgagaagtccgcggccatcgacggcgagtaccggctcaagggcgagtcccgcaagacgttcgtcgagctgatgcggcgcggggacctgcccgtgtggctcgcccacaaggtcgccagcgagggcatcaagtacaccgaccggaagtggtgcttcgacgggcagcgcaacaaccagatcctggaggagaacatggacgtggagatctggaccaaggagggcgagaagaagaagctgcggccccgctggctcgacgcccgcacctactccgacccgctggcgctgaaggagttcaaggacttcgccgccggccgcaagagcatcgccctcgacctggtgacggagatcgggcgcgtcccctcccacctggcccaccggacccgcaacgcgctcgacaacctggtgatgctgcacaccagcgagcacggcgggcgggcctaccgccacgccgtggaggagctccccgagaccatggagacgctgctgctcctgggcctgatgatcctcctgaccgggggcgccatgctgttcctcatcagcggcaaggggatcggcaagacctccatcgggctgatctgcgtcatcgccagctccggcatgctgtggatggcggagatcccgctccagtggatcgccagcgccatcgtgctggagttcttcatgatggtgctgctcatccccgagcccgagaagcagcggacgccccaggacaaccagctggcctacgtcgtgatcgggatcctgacgctcgccgcgatcatcgccgccaacgagatgggcctgctggagaccaccaagcgcgacctcggcatgtccaaggagccgggggtggtcagccccacctcctacctggacgtggacctgcaccccgccagcgcgtggacgctctacgccgtggccaccaccgtcatcacccccatgctgcggcacacgatcgagaactccaccgccaacgtgagcctggccgcgatcgccaaccaggccgtggtcctcatgggcctggacaaggggtggccgatctccaagatggacctgggcgtgcccctcctggccctggggtgctacagccaggtgaaccccctcaccctgaccgccgcggtcctgctcctgatcacgcactacgccatcatcggccccggcctgcaggccaaggccacccgcgaggcccagaagcggaccgcggccgggatcatgaagaacccgaccgtggacggcatcatgacgatcgacctcgaccccgtgatctacgactccaagttcgagaagcagctggggcaggtcatgctgctcgtgctgtgcgccgtgcagctgctcctgatgcgcaccagctgggccctgtgcgaggcgctcaccctggccaccggccccatcacgaccctgtgggagggctcccccgggaagttctggaacaccaccatcgccgtcagcatggccaacatcttccggggctcctacctcgccggggcgggcctggccttcagcatcatgaagtccgtggggacgggcaagcgcggcaccgggagccagggcgagaccctgggggagaagtggaagaagaagctcaaccagctgagccggaaggagttcgacctgtacaagaagtccggcatcaccgaggtggaccgcaccgaggccaaggaggggctcaagcggggcgagatcacgcaccacgccgtcagccgcggctccgccaagctgcagtggttcgtggagcggaacatggtgatcccggaggggcgcgtcatcgacctgggctgcgggcggggcgggtggagctactactgcgcgggcctcaagaaggtgaccgaggtgcgcggctacaccaagggcgggcccgggcacgaggagcccgtccccatgtccacctacggctggaacatcgtgaagctgatgagcgggaaggacgtgttctacctgccgcccgagaagtgcgacacgctcctgtgcgacatcggcgagtccagcccctcccccaccgtcgaggagagccgcaccatccgggtgctgaagatggtggagccgtggctgaagaacaaccagttctgcatcaaggtcctcaacccctacatgcccaccgtgatcgagcacctggagcgcctgcagcggaagcacggcgggatgctcgtgcgcaaccccctgtcccggaacagcacgcacgagatgtactggatctccaacggcaccgggaacatcgtcgccagcgtgaacatggtgtcccgcctgctcctgaaccggttcaccatgacccaccgccggccgacgatcgagaaggacgtcgacctgggcgccggcacccgccacgtgaacgccgagcccgagacccccaacatggacgtgatcggggagcggatcaagcgcatcaaggaggagcacaacagcacctggcactacgacgacgagaacccgtacaagacgtgggcctaccacggctcctacgaggtcaaggcgaccgggagcgcctccagcatgatcaacggcgtggtcaagctcctgaccaagccctgggacgtggtgcccatggtcacccagatggccatgacggacaccacccccttcgggcagcagcgggtgttcaaggagaaggtggacacccgcacgccgcggagcatgcccggcacccgccgggtcatgggcatcaccgccgagtggctgtggcgcaccctcgggcggaacaagaagccccgcctgtgcacgcgcgaggagttcaccaagaaggtgcggaccaacgcggccatgggcgccgtgttcaccgaggagaaccagtgggactccgccaaggccgcggtcgaggacgaggacttctggaagctggtggaccgcgagcgggagctccacaagctggggaagtgcggcagctgcgtgtacaacatgatggggaagcgcgagaagaagctgggcgagttcggcaaggccaaggggtcccgggccatctggtacatgtggctcggcgcccgctacctggagttcgaggccctggggttcctcaacgaggaccactggttcagccgggagaactcctacagcggcgtcgagggggagggcctgcacaagctgggctacatcctccgcgacatctccaagatccccgggggcgcgatgtacgccgacgacacggccgggtgggacacccggatcaccgaggacgacctgcacaacgaggagaagatcacccagcagatggacccggagcaccgccagctggccaacgccatcttcaagctcacgtaccagaacaaggtggtgaaggtccagcggcccacccccaccggcaccgtgatggacatcatcagccgcaaggaccagcggggctccggccaggtgggcacctacgggctgaacacgttcaccaacatggaggcgcagctgatccgccagatggagggcgagggggtcctcagcaaggccgacctggagaacccccacctccccgagaagaagatcacccagtggctggagaccaagggcgtggagcggctgaagcgcatggccatctccggcgacgactgcgtggtcaagcccatcgacgaccggttcgccaacgccctgctcgcgctgaacgacatggggaaggtgcgcaaggacatcccccagtggcagcccagcaagggctggcacgactggcagcaggtcccgttctgctcccaccacttccacgagctgatcatgaaggacgggcggaagctcgtcgtgccctgccgcccccaggacgagctgatcggccgggcccgcatcagccagggggccggctggtccctgcgcgagacggcctgcctcggcaaggcgtacgcccagatgtggagcctgatgtacttccaccggcgcgacctgcggctcgcctccaacgccatctgcagcgccgtgcccgtccactgggtgccgacctcccgcaccacctggagcatccacgcgcaccaccagtggatgacgaccgaggacatgctgaccgtgtggaaccgggtctggatcgaggacaacccctggatggaggacaagacccccgtgacgacctgggagaacgtgccctacctggggaagcgcgaggaccagtggtgcggcagcctcatcgggctgacctcccgggccacctgggcccagaacatcccgacggccatccagcaggtccgcagcctgatcggcaacgaggagttcctcgactacatgccctccatgaagcggttccgcaaggaggaggagagcgagggggccatctggtga

SEQ ID NO: 9833 - RNA, 9873 nt, synthetic construct
  misc_feature 1..9873: note = derived and/or modified CDS sequence (opt1) from DENV-3__JX669493__SS-prME
  source 1..9873: mol_type = other RNA
accagcttctgcctgatgatgatcctccccgcggccctggcgttccacctgaccagccgggacggggagccgcggatgatcgtggggaagaacgagcgcggcaagagcctcctgttcaagaccgcctccgggatcaacatgtgcaccctgatcgccatggacctcggggagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctggcgccccacgtgggcatggggctcgacacccggacccagacctggatgagcgccgagggcgcctggcgccaggtggagaaggtggagacgtgggccctgcggcacccggggttcaccatcctggccctcttcctggcccactacatcggcacctccctgacccagaaggtggtgatcttcatcctcctgatgctggtgacgcccagcatgaccatgcgctgcgtgggggtgggcaaccgggacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcgcaagctctgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctgttcgggaagggctccctcgtgacctgcgccaagttccagtgcctggagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctccccgagtacggcaccctggggctggagtgctccccgcggaccggcctcgacttcaacgagatgatcctgctgacgatgaagaacaaggcctggatggtgcaccgccagtggttcttcgacctccccctgccctggaccagcggcgccaccaccgagacgcccacctggaaccggaaggagctgctcgtgaccttcaagaacgcccacgccaagaagcaggaggtcgtggtgctggggtcccaggagggcgcgatgcacaccgccctgacgggggccaccgagatccagaacagcggcgggacctccatcttcgccggccacctcaagtgccgcctgaagatggacaagctggagctcaagggcatgagctacgccatgtgcaccaacacgttcgtcctgaagaaggaggtgtccgagacccagcacgggaccatcctgatcaaggtggagtacaagggcgaggacgcgccgtgcaagatccccttcagcaccgaggacgggcagggcaaggcccacaacggccggctcatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctgaacagcctcggcaagatggtccaccagatcttcgggtccgcctacacggccctgttcagcggcgtgtcctgggtgatgaagatcggcatcggggtcctgctcacctggatcggcctgaacagcaagaacacctccatgagcttctcctgcatcgccatcgggatcatcaccctgtacctcggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctggccaccgccatcgccggcgcgtgggagaacggggtctgcggcatccggagcacgacccgcatggagaacctcctgtggaagcagatcgccaacgagctgaactacatcctctgggagaacaacatcaagctgaccgtggtggtcggggacatcatcggcgtgctggagcagggcaagcggaccctcacgccccagccgatggagctgaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctgaagctccgggaggtctacacccagctgtgcgaccaccgcctgatgagcgccgccgtgaaggacgagcgggccgtgcacgcggacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggccgggcccatctcccagcacaaccaccgcccgggctaccacacccagaccgccgggccctggcacctgggcaagctcgagctggacttcaactactgcgagggcacgaccgtggtcatcaccgagaactgcgggacccggggccccagcctgcgcacgaccaccgtgtccgggaagctcatccacgagtggtgctgccggagctgcaccctgcccccgctgcgctacatcggcgaggacgggtgctggtacggcatggagatccggcccatctccgagaaggaggagaacatggtcaagagcctcgtctccgccggcagcgggaaggtggacaacttcacgatgggcgtgctgtgcctggcgatcctcttcgaggaggtcatgcgcgggaagttcggcaagaagcacatgatcgccggggtgttcttcaccttcgtgctgctgctctccggccagatcacctggcgggacatggcccacaccctgatcatgatcggcagcaacgcctccgaccgcatggggatgggcgtcacgtacctggccctcatcgcgaccttcaagatccagcccttcctggccctggggttcttcctccggaagctgaccagccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatcagcctgacgtgctccaacaccatgttcaccctcaccgtggcctggcggacggcgaccctgatcctggccggggtcagcctcctgccggtgtgccagtccagctccatgcgcaagaccgactggctgcccatggccgtcgccgccatgggcgtgccgcccctcccgctgttcatcttcagcctgaaggacaccctcaagcgccggtcctggcccctgaacgagggggtgatggcggtcggcctggtgagcatcctcgcctccagcctgctgcgcaacgacgtgcccatggccggccccctcgtcgccgggggcctgctgatcgcctgctacgtgatcacggggacctccgcggacctcaccgtggagaaggccgccgacatcacctgggaggaggaggccgagcagacgggcgtcagccacaacctgatgatcaccgtggacgacgacgggaccatgcggatcaaggacgacgagaccgagaacatcctgaccgtgctcctgaagacggccctgctcatcgtctccggcgtgttcccgtacagcatccccgcgaccctgctggtgtggcacacctggcagaagcagacccagcgctccggcgtcctctgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggcctccgtcaagaaggacctgatcagctacggcgggggctggcgcctgtccgcgcagtggcagaagggggaggaggtccaggtgatcgccgtcgagcccggcaagaaccccaagaacttccagaccatgcccggcaccttccagaccacgaccggggagatcggcgccatcgccctcgacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctgaccatcatggacctccaccccgggagcggcaagacccggaagtacctgccggccatcgtccgcgaggccatcaagcggcgcctgcggacgctcatcctggcccccacccgcgtggtggccgcggagatggaggaggccctgaaggggctccccatccggtaccagaccaccgccacgaagtccgagcacaccggccgcgagatcgtcgacctgatgtgccacgccaccttcaccatgcggctgctcagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctctcccggaagaccttcgacacggagtaccagaagaccaagctgaacgactgggacttcgtggtgaccaccgacatcagcgagatgggcgccaacttcaaggcggaccgcgtcatcgacccgcggcgctgcctgaagcccgtgatcctcacggacggccccgagcgggtgatcctggccgggcccatgccggtcaccgccgcctccgccgcgcagcgccggggccgcgtggggcggaacccccagaaggagaacgaccagtacatcttcaccggccagcccctgaacaacgacgaggaccacgcccactggaccgaggccaagatgctcctggacaacatcaacacccccgaggggatcatcccggccctgttcgagcccgagcgcgagaagtccgcggccatcgacggcgagtaccggctcaagggcgagtcccgcaagacgttcgtggagctgatgcggcgcggggacctgcccgtctggctcgcccacaaggtggccagcgagggcatcaagtacaccgaccggaagtggtgcttcgacgggcagcgcaacaaccagatcctggaggagaacatggacgtcgagatctggaccaaggagggcgagaagaagaagctgcggccccgctggctcgacgcccgcacctactccgacccgctggcgctgaaggagttcaaggacttcgccgccggccgcaagagcatcgccctcgacctggtgacggagatcgggcgcgtgccctcccacctggcccaccggacccgcaacgcgctcgacaacctggtcatgctgcacaccagcgagcacggcgggcgggcctaccgccacgccgtggaggagctccccgagaccatggagacgctgctgctcctgggcctgatgatcctcctgaccgggggcgccatgctgttcctcatcagcggcaaggggatcggcaagacctccatcgggctgatctgcgtgatcgccagctccggcatgctgtggatggcggagatcccgctccagtggatcgccagcgccatcgtcctggagttcttcatgatggtgctgctcatccccgagcccgagaagcagcggacgccccaggacaaccagctggcctacgtggtcatcgggatcctgacgctcgccgcgatcatcgccgccaacgagatgggcctgctggagaccaccaagcgcgacctcggcatgtccaaggagccgggggtggtgagccccacctcctacctggacgtcgacctgcaccccgccagcgcgtggacgctctacgccgtggccaccaccgtgatcacccccatgctgcggcacacgatcgagaactccaccgccaacgtcagcctggccgcgatcgccaaccaggccgtggtgctcatgggcctggacaaggggtggccgatctccaagatggacctgggcgtccccctcctggccctggggtgctacagccaggtgaaccccctcaccctgaccgccgcggtgctgctcctgatcacgcactacgccatcatcggccccggcctgcaggccaaggccacccgcgaggcccagaagcggaccgcggccgggatcatgaagaacccgaccgtcgacggcatcatgacgatcgacctcgaccccgtgatctacgactccaagttcgagaagcagctgggccaggtgatgctgctcgtcctgtgcgccgtgcagctgctcctgatgcgcaccagctgggccctgtgcgaggcgctcaccctggccaccggccccatcacgaccctgtgggagggctcccccgggaagttctggaacaccaccatcgccgtgagcatggccaacatcttccggggctcctacctcgccggggcgggcctggccttcagcatcatgaagtccgtcgggacgggcaagcgcggcaccgggagccagggcgagaccctgggggagaagtggaagaagaagctcaaccagctgagccggaaggagttcgacctgtacaagaagtccggcatcaccgaggtggaccgcaccgaggccaaggaggggctcaagcggggcgagatcacgcaccacgccgtgagccgcggctccgccaagctgcagtggttcgtcgagcggaacatggtgatcccggaggggcgcgtgatcgacctgggctgcgggcggggcgggtggagctactactgcgcgggcctcaagaaggtcaccgaggtgcgcggctacaccaagggcgggcccgggcacgaggagcccgtgcccatgtccacctacggctggaacatcgtcaagctgatgagcgggaaggacgtgttctacctgccgcccgagaagtgcgacacgctcctgtgcgacatcggcgagtccagcccctcccccaccgtggaggagagccgcaccatccgggtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgtcccggaacagcacgcacgagatgtactggatctccaacggcaccgggaacatcgtggccagcgtcaacatggtgtcccgcctgctcctgaaccggttcaccatgacccaccgccggccgacgatcgagaaggacgtggacctgggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctcctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgccgagtggctgtggcgcaccctcgggcggaacaagaagccccgcctgtgcacgcgcgaggagttcaccaagaaggtccggaccaacgcggccatgggcgccgtgttcaccgaggagaaccagtgggactccgccaaggccgcggtggaggacgaggacttctggaagctggtcgaccgcgagcgggagctccacaagctggggaagtgcggcagctgcgtgtacaacatgatggggaagcgcgagaagaagctgggcgagttcggcaaggccaaggggtcccgggccatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgcgatgtacgccgacgacacggccgggtgggacacccggatcaccgaggacgacctgcacaacgaggagaagatcacccagcagatggacccggagcaccgccagctggccaacgccatcttcaagctcacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcgcagctgatccgccagatggagggcgagggggtgctcagcaaggccgacctggagaacccccacctccccgagaagaagatcacccagtggctggagaccaagggcgtcgagcggctgaagcgcatggccatctccggcgacgactgcgtggtgaagcccatcgacgaccggttcgccaacgccctgctcgcgctgaacgacatggggaaggtccgcaaggacatcccccagtggcagcccagcaagggctggcacgactggcagcaggtcccgttctgctcccaccacttccacgagctgatcatgaaggacgggcggaagctcgtggtcccctgccgcccccaggacgagctgatcggccgggcccgcatcagccagggggccggctggtccctgcgcgagacggcctgcctcggcaaggcgtacgcccagatgtggagcctgatgtacttccaccggcgcgacctgcggctcgcctccaacgccatctgcagcgccgtgcccgtgcactgggtcccgacctcccgcaccacctggagcatccacgcgcaccaccagtggatgacgaccgaggacatgctgaccgtgtggaaccgggtgtggatcgaggacaacccctggatggaggacaagacccccgtcacgacctgggagaacgtgccctacctggggaagcgcgaggaccagtggtgcggcagcctcatcgggctgacctcccgggccacctgggcccagaacatcccgacggccatccagcaggtccgcagcctgatcggcaacgaggagttcctcgactacatgccctccatgaagcggttccgcaaggaggaggagagcgagggggccatctggtga

SEQ ID NO: 9834 - RNA, 9873 nt, synthetic construct
  misc_feature 1..9873: note = derived and/or modified CDS sequence (opt1) from DENV-3__JX669504__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagaccgcctccgggaccaacatgtgcaccctcatcgccatggacctgggggagatgtgcgacgacaccgtgacctacaagtgcccccacatcaccgaggtggagcccgaggacatcgactgctggtgcaacctgaccagcacctgggtgacgtacgggacctgcaaccaggccggcgagcggcgccgggacaagcgctccgtggccctcgcgccccacgtgggcatggggctggacacccggacccagacgtggatgagcgccgagggcgcctggcgccaggtggagaaggtggagacctgggccctgcggcacccggggttcaccatcctcgcgctgttcctggcccactacatcggcacctccctcacgcagaaggtggtgatcttcatcctgctgatgctcgtgacccccagcatgaccatgcgctgcgtgggggtgggcaaccgggacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccgcaagctgtgcatcgagggcaagatcaccaacatcaccacggacagccggtgccccacccagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcggacgggcctggacttcaacgagatgatcctgctcaccatgaagaacaaggcctggatggtgcaccgccagtggttcttcgacctgcccctgccctggaccagcggcgccaccacggagacccccacctggaaccggaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtcctgaagaaggaggtgtccgagacccagcacgggaccatcctcatcaaggtggagtaccggggcgaggacgcgccgtgcaagatccccttcagcacggaggacgggcagggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcggctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcaccctggtgctcctgctgtccggccagatcacctggcgcgacatggcccacacgctcatcatgatcggcagcaacgcctccgaccggatggggatgggcgtcacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatgttcaccctgacggtggcctggcgcaccgcgaccctcatcctggccggggtcagcctgctcccggtgtgccagtccagctccatgcgcaagaccgactggctgcccatggccgtcgccgccatgggcgtgccgcccctgcccctgttcatcttcagcctgaaggacacgctgaagcggcgctcctggcccctcaacgagggggtgatggcggtcggcctggtgagcatcctggcctccagcctcctgcggaacgacgtgcccatggccggccccctggtcgccgggggcctcctgatcgcctgctacgtgatcaccgggacctccgcggacctgaccgtggagaaggccgccgacatcacgtgggaggaggaggccgagcagaccggcgtcagccacaacctcatgatcaccgtggacgacgacgggaccatgcgcatcaaggacgacgagaccgagaacatcctgacggtgctgctcaagaccgccctgctgatcgtctccggcgtgttcccgtacagcatccccgcgaccctcctggtgtggcacacctggcagaagcagacgcagcggtccggcgtcctgtgggacgtgcccagcccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacctacaacgggaagcgcctggagcccaactgggcctccgtcaagaaggacctcatcagctacggcgggggctggcggctgtccgcgcagtggcagaagggggaggaggtccaggtgatcgccgtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgcggagccggacggccccacccccgagctcgaggaggagatgttcaagaagcggaacctgaccatcatggacctgcaccccgggagcggcaagacgcgcaagtacctcccggccatcgtccgggaggccatcaagcgccggctgcgcaccctgatcctcgcccccacccgggtggtggccgcggagatggaggaggccctgaaggggctgcccatccgctaccagaccacggccaccaagtccgagcacaccggccgggagatcgtcgacctcatgtgccacgccaccttcacgatgcgcctgctgagccccgtgcgggtgccgaactacaacctcatcatcatggacgaggcccacttcaccgaccccgcgtccatcgccgcccgcgggtacatcagcacccgcgtcggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcaccgacttcgccgggaagaccgtgtggttcgtgcccagcatcaaggccggcaacgacatcgccaactgcctgcggaagaacgggaagaaggtcatccagctgtcccgcaagacgttcgacaccgagtaccagaagaccaagctcaacgactgggacttcgtggtgaccacggacatcagcgagatgggcgccaacttcaaggcggaccgggtcatcgacccgcgccggtgcctgaagcccgtgatcctgaccgacggccccgagcgcgtgatcctcgccgggcccatgccggtcaccgccgcctccgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacacgcccgaggggatcatcccggccctgttcgagcccgagcgggagaagtccgcggccatcgacggcgagtaccgcctgaagggcgagtcccggaagaccttcgtggagctcatgcgccgcggggacctgcccgtctggctggcccacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccgctggctggacgcccggacgtactccgacccgctcgcgctgaaggagttcaaggacttcgccgccggccgcaagagcatcgccctggacctcgtgaccgagatcgggcgggtgccctcccacctggcccaccgcacccggaacgcgctggacaacctcgtcatgctgcacaccagcgagcacggcgggcgcgcctaccggcacgccgtggaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggcggagatcccgctgcagtggatcgccagcgccatcgtcctcgagttcttcatgatggtgctgctgatccccgagcccgagaagcagcgcacgccccaggacaaccagctcgcctacgtggtcatcgggatcctgaccctggccgcgatcatcgccgccaacgagatgggcctcctggagaccaccaagcgggacctgggcatgtccaaggagccgggggtggtgagccccacgtcctacctcgacgtcgacctgcaccccgccagcgcgtggaccctgtacgccgtggccaccaccgtgatcacgcccatgctccgccacaccatcgagaactccaccgccaacgtcagcctggccgcgatcgccaaccaggccgtggtgctgatgggcctcgacaaggggtggccgatctccaagatggacctgggcgtccccctgctcgccctggggtgctacagccaggtgaaccccctgaccctcacggccgcggtgctgctgctcatcacccactacgccatcatcggccccggcctgcaggccaaggccacccgggaggcccagaagcgcaccgcggccgggatcatgaagaacccgacggtcgacggcatcatgaccatcgacctggaccccgtgatctacgactccaagttcgagaagcagctcggccaggtgatgctgctggtcctctgcgccgtgcagctgctgctcatgcggaccagctgggccctgtgcgaggcgctgaccctcgccacgggccccatcaccaccctgtgggagggctcccccgggaagttctggaacaccacgatcgccgtgagcatggccaacatcttccgcggctcctacctggccggggcgggcctcgccttcagcatcatgaagtccgtcgggaccggcaagcggggcaccgggagccagggcgagaccctgggggagaagtggaagaagaagctgaaccagctcagccgcaaggagttcgacctgtacaagaagtccggcatcaccgaggtggaccggacggaggccaaggaggggctgaagcgcggcgagatcacccaccacgccgtgagccggggctccgccaagctccagtggttcgtcgagcgcaacatggtgatcccggaggggcgggtgatcgacctgggctgcgggcgcggcgggtggagctactactgcgcgggcctgaagaaggtcaccgaggtgcgcggctacaccaagggcgggcccgggcacgaggagcccgtgcccatgtccacgtacggctggaacatcgtcaagctcatgagcgggaaggacgtgttctacctgccgcccgagaagtgcgacaccctgctgtgcgacatcggcgagtccagcccctcccccaccgtggaggagagccggaccatccgcgtcctcaagatggtggagccgtggctgaagaacaaccagttctgcatcaaggtgctgaacccctacatgcccacggtcatcgagcacctcgagcggctgcagcgcaagcacggcgggatgctggtgcggaaccccctctcccgcaacagcacccacgagatgtactggatctccaacggcaccgggaacatcgtggccagcgtcaacaccgtgtcccggctgctgctcaaccgcttcacgatgacccaccggcgcccgaccaccgagaaggacgtggacctgggcgccggcacgcggcacgtcaacgccgagcccgagacccccaacatggacgtgatcggggagcgcatcaagcggatcaaggaggagcacaacagcacctggcactacgacgacgagaacccgtacaagacctgggcctaccacggctcctacgaggtgaaggcgacggggagcgcctccagcatgatcaacggcgtcgtgaagctgctcaccaagccctgggacgtcgtgcccatggtgacccagatggccatgaccgacacgacccccttcgggcagcagcgcgtcttcaaggagaaggtggacacccggaccccgcgcagcatgcccggcacgcggcgcgtgatgggcatcaccgccgagtggctgtggcggaccctggggcgcaacaagaagccccgcctctgcacccgggaggagttcacgaagaaggtccgcaccaacgcggccatgggcgccgtgttcaccgaggagaaccagtgggactccgccaaggccgcggtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgccatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgcgatgtacgccgacgacaccgccgggtgggacacgcgcatcaccgaggacgacctccacaacgaggagaagatcacccagcagatggacccggagcaccggcagctggccaacgccatcttcaagctgacctaccagaacaaggtcgtgaaggtgcagcgccccacccccacgggcaccgtcatggacatcatcagccggaaggaccagcgcggctccggccaggtgggcacctacgggctcaacaccttcacgaacatggaggcgcagctgatccggcagatggagggcgagggggtgctgagcaaggccgacctcgagaacccccacctcccggagaagaagatcacccagtggctggagaccaagggcgtcgagcgcctcaagcggatggccatctccggcgacgactgcgtggtgaagcccatcgacgaccgcttcgccaacgccctgctggcgctcaacgacatggggaaggtccggaaggacatcccccagtggcagcccagcaagggctggcacgactggcagcaggtcccgttctgctcccaccacttccacgagctgatcatgaaggacgggcgcaagctggtggtcccctgccggccccaggacgagctcatcggccgcgcccgcatcagccagggggccggctggtccctgcgggagaccgcctgcctgggcaaggcgtacgcccagatgtggagcctcatgtacttccaccgccgggacctgcgcctggcctccaacgccatctgcagcgccgtgcccgtgcactgggtcccgacgtcccggaccacctggagcatccacgcgcaccaccagtggatgaccacggaggacatgctcaccgtgtggaaccgcgtgtggatcgaggacaacccctggatggaggacaagacccccgtcaccacgtgggagaacgtgccctacctggggaagcgggaggaccagtggtgcggcagcctgatcgggctcacctcccgcgccacctgggcccagaacatcccgaccgccatccagcaggtccggagcctgatcggcaacgaggagttcctggactacatgccctccatgaagcgcttccggaaggaggaggagagcgagggggccatctggtga

SEQ ID NO: 9835 - RNA, 9873 nt, synthetic construct
  misc_feature 1..9873: note = derived and/or modified CDS sequence (opt1) from DENV-3__JX669506__SS-prME
  source 1..9873: mol_type = other RNA
accagcttctgcctgatgatgatcctccccgcggccctggcgttccacctgaccagccgggacggggagccgcggatgatcgtggggaagaacgagcgcggcaagagcctcctgttcaagaccgcctccgggatcaacatgtgcaccctgatcgccatggacctcggggagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctggcgccccacgtgggcatggggctcgacacccggacccagacctggatgagcgccgagggcgcctggcgccaggtggagaaggtggagacgtgggccctgcggcacccggggttcaccatcctggccctcttcctggcccactacatcggcacctccctgacccagaaggtggtgatcttcatcctcctgatgctggtgacgcccagcatgaccatgcgctgcgtgggggtgggcaaccgggacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcgcaagctctgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctgttcgggaagggctccctcgtgacctgcgccaagttccagtgcctggagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctccccgagtacggcaccctggggctggagtgctccccgcggaccggcctcgacttcaacgagatgatcctgctgacgatgaagaacaaggcctggatggtgcaccgccagtggttcttcgacctccccctgccctggaccagcggcgccaccaccgagacgcccacctggaaccggaaggagctgctcgtgaccttcaagaacgcccacgccaagaagcaggaggtcgtggtgctggggtcccaggagggcgcgatgcacaccgccctgacgggggccaccgagatccagaacagcggcgggacctccatcttcgccggccacctcaagtgccgcctgaagatggacaagctggagctcaagggcatgagctacgccatgtgcaccaacacgttcgtcctgaagaaggaggtgtccgagacccagcacgggaccatcctgatcaaggtggagtacaagggcgaggacgcgccgtgcaagatccccttcagcaccgaggacgggcagggcaaggcctacaacggccggctcatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctgaacagcctcggcaagatggtccaccagatcttcgggtccgcctacacggccctgttcagcggcgtgtcctgggtgatgaagatcggcatcggggtcctgctcacctggatcggcctgaacagcaagaacacctccatgagcttctcctgcatcgccatcgggatcatcaccctgtacctcggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctggccaccgccatcgccggcgcgtgggagaacggggtctgcggcatccggagcacgacccgcatggagaacctcctgtggaagcagatcgccaacgagctgaactacatcctctgggagaacaacatcaagctgaccgtggtggtcggggacatcatcggcgtgctggagcagggcaagcggaccctcacgccccagccgatggagctgaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctgaagctccgggaggtctacacccagctgtgcgaccaccgcctgatgagcgccgccgtgaaggacgagcgggccgtgcacgcggacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggccgggcccatctcccagcacaaccaccgcccgggctaccacacccagaccgccgggccctggcacctgggcaagctcgagctggacttcaactactgcgagggcacgaccgtggtcatcaccgagaactgcgggacccggggccccagcctgcgcacgaccaccgtgtccgggaagctcatccacgagtggtgctgccggagctgcaccctgcccccgctgcgctacatgggcgaggacgggtgctggtacggcatggagatccggcccatctccgagaaggaggagaacatggtcaagagcctcgtctccgccggcagcgggaaggtggacaacttcacgatgggcgtgctgtgcctggcgatcctcttcgaggaggtcatgcgcgggaagttcggcaagaagcacatgatcgccggggtgttcttcaccttcgtgctgctgctctccggccagatcacctggcgggacatggcccacaccctgatcatgatcggcagcaacgcctccgaccgcatggggatgggcgtcacgtacctggccctcatcgcgaccttcaagatccagcccttcctggccctggggttcttcctccggaagctgaccagccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatcagcctgacgtgctccaacaccatgttcaccctcaccgtggcctggcggacggcgaccctgatcctggccggggtcagcctcctgccggtgtgccagtccagctccatgcgcaagaccgactggctgcccatggccgtcgccgccatgggcgtgccgcccctcccgctgttcatcttcagcctgaaggacaccctcaagcgccggtcctggcccctgaacgagggggtgatggcggtcggcctggtgagcatcctcgcctccagcctgctgcgcaacgacgtgcccatggccggccccctcgtcgccgggggcctgctgatcgcctgctacgtgatcacggggacctccgcggacctcaccgtggagaaggccgccgacatcacctgggaggaggaggccgagcagacgggcgtcagccacaacctgatgatcaccgtggacgacgacgggaccatgcggatcaaggacgacgagaccgagaacatcctgaccgtgctcctgaagacggccctgctcatcgtctccggcgtgttcccgtacagcatccccgcgaccctgctggtgtggcacacctggcagaagcagacccagcgctccggcgtcctctgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggcctccgtcaagaaggacctgatcagctacggcgggggctggcgcctgtccgcgcagtggcagaagggggaggaggtccaggtgatcgccgtcgagcccggcaagaaccccaagaacttccagaccatgcccggcaccttccagaccacgaccggggagatcggcgccatcgccctcgacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctgaccatcatggacctccaccccgggagcggcaagacccggaagtacctgccggccatcgtccgcgaggccatcaagcggcgcctgcggacgctcatcctggcccccacccgcgtggtggccgcggagatggaggaggccctgaaggggctccccatccggtaccagaccaccgccacgaagtccgagcacaccggccgcgagatcgtcgacctgatgtgccacgccaccttcaccatgcggctgctcagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctctcccggaagaccttcgacacggagtaccagaagaccaagctgaacgactgggacttcgtggtgaccaccgacatcagcgagatgggcgccaacttcaaggcggaccgcgtcatcgacccgcggcgctgcctgaagcccgtgatcctcacggacggccccgagcgggtgatcctggccgggcccatgccggtcaccgccgcctccgccgcgcagcgccggggccgcgtggggcggaacccccagaaggagaacgaccagtacatcttcaccggccagcccctgaacaacgacgaggaccacgcccactggaccgaggccaagatgctcctggacaacatcaacacccccgaggggatcatcccggccctgttcgagcccgagcgcgagaagtccgcggccatcgacggcgagtaccggctcaagggcgagtcccgcaagacgttcgtggagctgatgcggcgcggggacctgcccgtctggctcgcccacaaggtggccagcgagggcatcaagtacaccgaccggaagtggtgcttcgacgggcagcgcaacaaccagatcctggaggagaacatggacgtcgagatctggaccaaggagggcgagaagaagaagctgcggccccgctggctcgacgcccgcacctactccgacccgctggcgctgaaggagttcaaggacttcgccgccggccgcaagagcatcgccctcgacctggtgacggagatcgggcgcgtgccctcccacctggcccaccggacccgcaacgcgctcgacaacctggtcatgctgcacaccagcgagcacggcgggcgggcctaccgccacgccgtggaggagctccccgagaccatggagacgctgctgctcctgggcctgatgatcctcctgaccgggggcgccatgctgttcctcatcagcggcaaggggatcggcaagacctccatcgggctgatctgcgtgatcgccagctccggcatgctgtggatggcggagatcccgctccagtggatcgccagcgccatcgtcctggagttcttcatgatggtgctgctcatccccgagcccgagaagcagcggacgccccaggacaaccagctggcctacgtggtcatcgggatcctgacgctcgccgcgatcatcgccgccaacgagatgggcctgctggagaccaccaagcgcgacctcggcatgtccaaggagccgggggtggtgagccccacctcctacctggacgtcgacctgcaccccgccagcgcgtggacgctctacgccgtggccaccaccgtgatcacccccatgctgcggcacacgatcgagaactccaccgccaacgtcagcctggccgcgatcgccaaccaggccgtggtgctcatgggcctggacaaggggtggccgatctccaagatggacctgggcgtccccctcctggccctggggtgctacagccaggtgaaccccctcaccctgaccgccgcggtgctgctcctgatcacgcactacgccatcatcggccccggcctgcaggccaaggccacccgcgaggcccagaagcggaccgcggccgggatcatgaagaacccgaccgtcgacggcatcatgacgatcgacctcgaccccgtgatctacgactccaagttcgagaagcagctgggccaggtgatgctgctcgtcctgtgcgccgtgcagctgctcctgatgcgcaccagctgggccctgtgcgaggcgctcaccctggccaccggccccatcacgaccctgtgggagggctcccccgggaagttctggaacaccaccatcgccgtgagcatggccaacatcttccggggctcctacctcgccggggcgggcctggccttcagcatcatgaagtccgtcgggacgggcaagcgcggcaccgggagccagggcgagaccctgggggagaagtggaagaagaagctcaaccagctgagccggaaggagttcgacctgtacaagaagtccggcatcaccgaggtggaccgcaccgaggccaaggaggggctcaagcggggcgagatcacgcaccacgccgtgagccgcggctccgccaagctgcagtggttcgtcgagcggaacatggtgatcccggaggggcgcgtgatcgacctgggctgcgggcggggcgggtggagctactactgcgcgggcctcaagaaggtcaccgaggtgcgcggctacaccaagggcgggcccgggcacgaggagcccgtgcccatgtccacctacggctggaacatcgtcaagctgatgagcgggaaggacgtgttctacctgccgcccgagaagtgcgacacgctcctgtgcgacatcggcgagtccagcccctcccccaccgtggaggagagccgcaccatccgggtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgtcccggaacagcacgcacgagatgtactggatctccaacggcaccgggaacatcgtggccagcgtcaacatggtgtcccgcctgctcctgaaccggttcaccatgacccaccgccggccgacgatcgagaaggacgtggacctgggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctcctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgccgagtggctgtggcgcaccctcgggcggaacaagaagccccgcctgtgcacgcgcgaggagttcaccaagaaggtccggaccaacgcggccatgggcgccgtgttcaccgaggagaaccagtgggactccgccaaggccgcggtggaggacgaggacttctggaagctggtcgaccgcgagcgggagctccacaagctggggaagtgcggcagctgcgtgtacaacatgatggggaagcgcgagaagaagctgggcgagttcggcaaggccaaggggtcccgggccatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgcgatgtacgccgacgacacggccgggtgggacacccggatcaccgaggacgacctgcacaacgaggagaagatcacccagcagatggacccggagcaccgccagctggccaacgccatcttcaagctcacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcgcagctgatccgccagatggagggcgagggggtgctcagcaaggccgacctggagaacccccacctccccgagaagaagatcacccagtggctggagaccaagggcgtcgagcggctgaagcgcatggccatctccggcgacgactgcgtggtgaagcccatcgacgaccggttcgccaacgccctgctcgcgctgaacgacatggggaaggtccgcaaggacatcccccagtggcagcccagcaagggctggcacgactggcagcaggtcccgttctgctcccaccacttccacgagctgatcatgaaggacgggcggaagctcgtggtcccctgccgcccccaggacgagctgatcggccgggcccgcatcagccagggggccggctggtccctgcgcgagacggcctgcctcggcaaggcgtacgcccagatgtggagcctgatgtacttccaccggcgcgacctgcggctcgcctccaacgccatctgcagcgccgtgcccgtgcactgggtcccgacctcccgcaccacctggagcatccacgcgcaccaccagtggatgacgaccgaggacatgctgaccgtgtggaaccgggtgtggatcgaggacaacccctggatggaggacaagacccccgtcacgacctgggagaacgtgccctacctggggaagcgcgaggaccagtggtgcggcagcctcatcgggctgacctcccgggccacctgggcccagaacatcccgacggccatccagcaggtccgcagcctgatcggcaacgaggagttcctcgactacatgccctccatgaagcggttccgcaaggaggaggagagcgagggggccatctggtga

SEQ ID NO: 9836 - RNA, 9873 nt, synthetic construct
  misc_feature 1..9873: note = derived and/or modified CDS sequence (opt1) from DENV-3__JX669496__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagaccgcctccgggaccaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacgtggatgagcgccgagggcgcctggcgccaggtggagaaggtggagacctgggccctgcggcacccggggttcaccatcctcgcgctgttcctggcccactacatcggcacctccctcacgcagaaggtggtgatcttcatcctgctgatgctcgtgacccccagcatgaccatgcgctgcgtgggggtgggcaaccgggacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccgcaagctgtgcatcgagggcaagatcaccaacatcaccacggacagccggtgccccacccagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcggacgggcctggacttcaacgagatgatcctgctcaccatgaagaacaaggcctggatggtgcaccgccagtggttcttcgacctgcccctgccctggaccagcggcgccaccacggagacccccacctggaaccggaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcgcgaacacgttcgtcctgaagaaggaggtgtccgagacccagcacgggaccatcctcatcaaggtggagtaccggggcgaggacgccccgtgcaagatccccttcagcaccgaggacgggcagggcaaggcccacaacggccgcctgatcacggccaaccccgtcgtgaccaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccgcatggcgatcctgggcgacaccgcctgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgcggtggtgcaggccgacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgcgggcgcctgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgcggtgcacgccgacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgcgggcagcgggaaggtggacaacttcacgatgggcgtgctgtgcctcgccatcctgttcgaggaggtcatgcgggggaagttcggcaagaagcacatgatcgccggggtgctgttcaccttcgtgctcctgctgtccggccagatcacctggcgcgacatggcccacaccctcatcatgatcggcagcaacgcctccgaccggatggggatgggcgtcacgtacctggcgctgatcgccaccttcaagatccagcccttcctcgccctggggttcttcctgcgcaagctcaccagccgggagaacctgctgctcggcgtgggcctggccatggcgaccacgctgcagctccccgaggacatcgagcagatggccaacgggatcgccctgggcctgatggccctcaagctgatcacccagttcgagacctaccagctgtggaccgccctcatcagcctgacgtgctccaacaccatgttcaccctgaccgtggcgtggcgcacggccaccctcatcctggccggggtcagcctgctcccggtgtgccagtccagctccatgcgcaagaccgactggctgcccatggccgtcgccgcgatgggcgtgccgcccctgcccctgttcatcttcagcctgaaggacaccctgaagcggcgctcctggcccctcaacgagggggtgatggccgtcggcctggtgagcatcctggcctccagcctcctgcggaacgacgtgcccatggccggccccctggtcgccgggggcctcctgatcgcgtgctacgtgatcacggggacctccgccgacctgaccgtggagaaggccgccgacatcacctgggaggaggaggccgagcagacgggcgtcagccacaacctcatgatcaccgtggacgacgacgggaccatgcgcatcaaggacgacgagaccgagaacatcctgaccgtgctgctcaagacggcgctgctgatcgtctccggcgtgttcccgtacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgtacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcgcagacgaacgccgagccggacggccccacccccgagctcgaggaggagatgttcaagaagcggaacctgaccatcatggacctgcaccccgggagcggcaagacccgcaagtacctcccggccatcgtccgggaggccatcaagcgccggctgcgcacgctgatcctcgcccccacccgggtggtggcggccgagatggaggaggccctgaaggggctgcccatccgctaccagaccaccgccacgaagtccgagcacaccggccgggagatcgtcgacctcatgtgccacgccaccttcaccatgcgcctgctgagccccgtgcgggtgccgaactacaacctcatcatcatggacgaggcgcacttcacggaccccgcctccatcgccgcccgcgggtacatcagcacccgcgtcggcatgggcgaggcggccgccatcttcatgaccgccacgccgcccgggacggccgacgcgttcccgcagtccaacgcccccatccaggacgaggagcgggacatccccgagcgcagctggaactccggcaacgagtggatcaccgacttcgccgggaagaccgtgtggttcgtgcccagcatcaaggccggcaacgacatcgccaactgcctgcggaagaacgggaagaaggtcatccagctgtcccgcaagaccttcgacacggagtaccagaagaccaagctcaacgactgggacttcgtggtgaccaccgacatcagcgagatgggcgcgaacttcaaggccgaccgggtcatcgacccgcgccggtgcctgaagcccgtgatcctgacggacggccccgagcgcgtgatcctcgccgggcccatgccggtcaccgccgcctccgcggcccagcggcgcggccgggtggggcgcaacccccagaaggagaacgaccagtacatcttcaccggccagcccctgaacaacgacgaggaccacgcccactggaccgaggccaagatgctgctcgacaacatcaacacccccgaggggatcatcccggcgctgttcgagcccgagcgggagaagtccgccgccatcgacggcgagtaccgcctgaagggcgagtcccggaagacgttcgtggagctcatgcgccgcggggacctgcccgtctggctggcccacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccgctggctggacgcgcggacctactccgacccgctcgccctgaaggagttcaaggacttcgccgccggccgcaagagcatcgccctggacctcgtgacggagatcgggcgggtgccctcccacctggcgcaccgcacccggaacgccctggacaacctcgtcatgctgcacaccagcgagcacggcgggcgcgcctaccggcacgccgtggaggagctgcccgagaccatggagacgctcctgctgctcggcctgatgatcctgctcaccgggggcgccatgctgttcctgatcagcggcaaggggatcggcaagacctccatcgggctcatctgcgtgatcgcgagctccggcatgctgtggatggccgagatcccgctgcagtggatcgccagcgccatcgtcctcgagttcttcatgatggtgctgctgatccccgagcccgagaagcagcgcacgccccaggacaaccagctcgcctacgtggtcatcgggatcctgacgctggcggccatcatcgccgccaacgagatgggcctcctggagaccaccaagcgggacctgggcatgtccaaggagccgggggtggtgagccccacctcctacctcgacgtcgacctgcaccccgcgagcgcctggacgctgtacgccgtggccaccaccgtgatcacccccatgctccgccacacgatcgagaactccaccgccaacgtcagcctggcggccatcgccaaccaggccgtggtgctgatgggcctcgacaaggggtggccgatctccaagatggacctgggcgtccccctgctcgccctggggtgctacagccaggtgaaccccctgaccctcaccgcggccgtgctgctgctcatcacgcactacgccatcatcggccccggcctgcaggccaaggccacccgggaggcgcagaagcgcaccgccgccgggatcatgaagaacccgaccgtcgacggcatcatgacgatcgacctggaccccgtgatctacgactccaagttcgagaagcagctcggccaggtgatgctgctggtcctctgcgccgtgcagctgctgctcatgcggaccagctgggcgctgtgcgaggccctgaccctcgccaccggccccatcacgaccctgtgggagggctcccccgggaagttctggaacaccaccatcgccgtgagcatggccaacatcttccgcggctcctacctggcgggggccggcctcgccttcagcatcatgaagtccgtcgggacgggcaagcggggcaccgggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagatcacgcaccacgccgtgagccggggctccgcgaagctccagtggttcgtcgagcgcaacatggtgatcccggaggggcgggtgatcgacctgggctgcgggcgcggcgggtggagctactactgcgccggcctgaagaaggtcaccgaggtgcgcggctacaccaagggcgggcccgggcacgaggagcccgtgcccatgtccacctacggctggaacatcgtcaagctcatgagcgggaaggacgtgttctacctgccgcccgagaagtgcgacacgctgctgtgcgacatcggcgagtccagcccctcccccaccgtggaggagagccggaccatccgcgtcctcaagatggtggagccgtggctgaagaacaaccagttctgcatcaaggtgctgaacccctacatgcccaccgtcatcgagcacctcgagcggctgcagcgcaagcacggcgggatgctggtgcggaaccccctctcccgcaacagcacgcacgagatgtactggatctccaacggcaccgggaacatcgtggccagcgtcaacaccgtgtcccggctgctgctcaaccgcttcaccatgacgcaccggcgcccgaccaccgagaaggacgtggacctgggcgccggcacccggcacgtcaacgccgagcccgagacgcccaacatggacgtgatcggggagcgcatcaagcggatcaaggaggagcacaacagcacctggcactacgacgacgagaacccgtacaagacctgggcgtaccacggctcctacgaggtgaaggccaccgggagcgcctccagcatgatcaacggcgtcgtgaagctgctcacgaagccctgggacgtcgtgcccatggtgacccagatggccatgaccgacaccacgcccttcgggcagcagcgcgtcttcaaggagaaggtggacacccggaccccgcgcagcatgcccggcacccggcgcgtgatgggcatcacggcggagtggctgtggcggaccctggggcgcaacaagaagccccgcctctgcacccgggaggagttcaccaagaaggtccgcacgaacgccgccatgggcgccgtgttcaccgaggagaaccagtgggactccgccaaggcggccgtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgccatctggtacatgtggctgggcgcccggtacctcgagttcgaggcgctggggttcctgaacgaggaccactggttcagccgcgagaactcctacagcggcgtggagggggagggcctccacaagctgggctacatcctgcgggacatctccaagatccccgggggcgccatgtacgccgacgacaccgccgggtgggacacccgcatcacggaggacgacctccacaacgaggagaagatcacccagcagatggacccggagcaccggcagctggccaacgcgatcttcaagctgacctaccagaacaaggtcgtgaaggtgcagcgccccacccccaccggcacggtcatggacatcatcagccggaaggaccagcgcggctccggccaggtgggcacctacgggctcaacaccttcaccaacatggaggcccagctgatccggcagatggagggcgagggggtgctgagcaaggccgacctcgagaacccccacctcccggagaagaagatcacgcagtggctggagaccaagggcgtcgagcgcctcaagcggatggccatctccggcgacgactgcgtggtgaagcccatcgacgaccgcttcgccaacgcgctgctggccctcaacgacatggggaaggtccggaaggacatcccccagtggcagcccagcaagggctggcacgactggcagcaggtcccgttctgctcccaccacttccacgagctgatcatgaaggacgggcgcaagctggtggtcccctgccggccccaggacgagctcatcggccgcgcccgcatcagccagggggccggctggtccctgcgggagaccgcgtgcctgggcaaggcctacgcccagatgtggagcctcatgtacttccaccgccgggacctgcgcctggcctccaacgccatctgcagcgcggtgcccgtgcactgggtcccgacctcccggacgacctggagcatccacgcccaccaccagtggatgaccaccgaggacatgctcacggtgtggaaccgcgtgtggatcgaggacaacccctggatggaggacaagacccccgtcaccacctgggagaacgtgccctacctggggaagcgggaggaccagtggtgcggcagcctgatcgggctcacgtcccgcgccacctgggcccagaacatcccgaccgccatccagcaggtccggagcctgatcggcaacgaggagttcctggactacatgccctccatgaagcgcttccggaaggaggaggagagcgagggggcgatctggtga

SEQ ID NO: 9837 - RNA, 9873 nt, synthetic construct
  misc_feature 1..9873: note = derived and/or modified CDS sequence (opt1) from DENV-3__JX669490__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtaccggggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcgcacggcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacaccctgaagcggcgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcgtgttcccgtacagcatccccgcgaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgcggagccggacggccccacccccgagctggaggaggagatgttcaagaagcggaacctcaccatcatggacctgcaccccgggagcggcaagacccgcaagtacctgccggccatcgtccgggaggccatcaagcgccggctccgcacgctgatcctggcccccacccgggtggtggccgcggagatggaggaggccctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcgtccatcgccgcccgcgggtacatcagcacccgcgtcggcatgggcgaggccgcggccatcttcatgaccgccacgccgcccgggacggccgacgccttcccgcagtccaacgcgcccatccaggacgaggagcgggacatccccgagcgcagctggaactccggcaacgagtggatcaccgacttcgccgggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggcggaccgggtcatcgacccgcgccggtgcctcaagcccgtgatcctgacggacggccccgagcgcgtgatcctggccgggcccatgccggtcaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccgctggctggacgcccggacctactccgacccgctggcgctcaaggagttcaaggacttcgccgccggccgcaagagcatcgccctggacctggtgacggagatcgggcgggtgccctcccacctcgcccaccgcacccggaacgcgctggacaacctggtcatgctccacaccagcgagcacggcgggcgcgcctaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcgcacgccccaggacaaccagctggcctacgtggtcatcgggatcctcacgctggccgcgatcatcgccgccaacgagatgggcctgctcgagaccaccaagcgggacctgggcatgtccaaggagccgggggtggtgagccccacctcctacctggacgtcgacctccaccccgccagcgcgtggacgctgtacgccgtggccaccaccgtgatcacccccatgctgcgccacacgatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacgcactacgccatcatcggccccggcctccaggccaaggccacccgggaggcccagaagcgcaccgcggccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggcgctgaccctggccaccggccccatcacgaccctctgggagggctcccccgggaagttctggaacaccaccatcgccgtgagcatggccaacatcttccgcggctcctacctggccggggcgggcctggccttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccggaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgccgagtggctctggcggaccctggggcgcaacaagaagccccgcctgtgcacgcgggaggagttcaccaagaaggtccgcaccaacgcggccatgggcgccgtgttcaccgaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcgcagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggcgctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccgcatcagccagggggccggctggtccctccgggagacggcctgcctgggcaaggcgtacgcccagatgtggagcctgatgtacttccaccgccgggacctccgcctggcctccaacgccatctgcagcgccgtgcccgtgcactgggtcccgacctcccggaccacctggagcatccacgcgcaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggcagcctgatcgggctgacctcccgcgccacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 9838 - RNA, 9873 nt, synthetic construct
  misc_feature 1..9873: note = derived and/or modified CDS sequence (opt1) from DENV-3__JN406515__SS-prME
  source 1..9873: mol_type = other RNA
accagcctgtgcctcatgatgatgctgcccgccaccctggccttccacctcacctcccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacgtacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtggagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgagcaggggaaggcccacaacggccggctgatcaccgccaaccccgtggtgaccaagaaggaggagcccgtcaacatcgaggcggagcccccgttcggcgagtccaacatcatcatcgggatcggcgacaaggccctgaagatcaactggtacaagaaggggagctccatcggcaagatgttcgaggccacggcccgcggggcccggcgcatggcgatcctcggcgacaccgcctgggacttcggcagcgtcgggggcgtgctgaactccctggggaagatggtccaccagatcttcggcagcgcctacaccgccctcttctccggggtgagctggatcatgaagatcggcatcggcgtgctgctgacctggatcgggctcaactccaagaacacgagcatgtccttcagctgcatcgtcatcggcatcatcaccctgtacctgggggccgtggtgcaggcggacatgggctgcgtcatcaactggaaggggaaggagctcaagtgcggctccggcatcttcgtgaccaacgaggtgcacacctggacggagcagtacaagttccaggccgacagccccaagcggctggccaccgccatcgccggggcgtgggagaacggcgtctgcgggatccgctccaccacccgcatggagaacctgctctggaagcagatcgccaacgagctgaactacatcctgtgggagaacaacatcaagctcacggtggtggtcggcgacatcatcggggtgctggagcagggcaagcggaccctgacgccccagcccatggagctcaagtacagctggaagacctggggcaaggccaagatcgtgacggccgagacccagaactccagcttcatcatcgacgggccgaacacccccgagtgccccaacgcgtcccgcgcctggaacgtctgggaggtggaggactacggcttcggggtgttcaccacgaacatctggctgaagctgcgggagatgtacacccagctctgcgaccaccgcctgatgagcgccgccgtcaaggacgagcgggccgtgcacgcggacatgggctactggatcgagagccagaagaacggctcctggaagctggagaaggccagcctcatcgaggtgaagacctgcacctggcccaagtcccacaccctgtggagcaacggggtcctggagtccgacatgatcatccccaagtccctcgccggccccatctcccagcacaactaccgccccgggtaccacacgcagaccgccggcccgtggcacctggggaagctggagctcgacttcaactactgcgagggcaccaccgtggtgatcacggagaactgcggcacccgggggcccagcctgcgcaccaccacggtctccggcaagctgatccacgagtggtgctgccggagctgcaccctgccgcccctccgctacatgggggaggacggctgctggtacgggatggagatccggccgatcaacgagaaggaggagaacatggtgaagtccctggtgagcgccggctccggcaaggtcgacaacttcaccatgggggtgctctgcctggcgatcctgttcgaggaggtgatgcgcggcaagttcgggaagaagcacatgatcgccggcgtcctcttcaccttcgtgctgctgctcagcgggcagatcacgtggcgggacatggcccgcaccctgatcatgatcggctccaacgccagcgaccggatgggcatgggggtgacctacctggccctcatcgcgaccttcaagatccagcccttcctggccctgggcttcttcctccgcaagctgacgtcccgggagaacctgctcctgggggtcggcctggccatggccaccaccctccagctgcccgaggacgtggagcagatggcgaacggcatcgccctggggctcatggccctgaagctgatcacccagttcgagacgtaccagctctggaccgccctggtgagcctgatgtgcagcaacaccatcttcaccctcacggtcgcctggcgcaccgcgaccctgatcctggccggcatctccctcttccccgtgtgccagagctccagcatgcggaagaccgactggctgccgatgacggtcgccgccatgggggtgccgcccctgcccctcttcatcttctccctgaaggacaccctgaagcgccgcagctggccgctcaacgagggcgtgatggccgtcgggctggtgtccatcctggcgagctccctcctgcggaacgacgtgcccatggccggccccctggtcgccggcgggctcctgatcgcctgctacgtgatcaccggcaccagcgccgacctgacggtggagaaggcggccgacgtcacctgggaggaggaggccgagcagaccggggtgtcccacaacctcatgatcaccgtggacgacgacggcacgatgcgcatcaaggacgacgagaccgagaacatcctgaccgtcctgctcaagaccgccctgctgatcgtgagcgggatcttcccctactccatcccggccaccctcctggtgtggcacacgtggcagaagcagacccagcggagcggcgtcctgtgggacgtgcccagcccgcccgagacccagaaggcggagctcgaggagggcgtgtaccgcatcaagcagcaggggatcttcggcaagacccaggtcggggtgggcgtgcagaaggagggggtcttccacacgatgtggcacgtgacccggggcgccgtgctgacctacaacggcaagcgcctggagccgaactgggccagcgtcaagaaggacctcatctcctacgggggcgggtggcggctgagcgcccagtggcagaagggcgaggaggtccaggtgatcgcggtcgagcccgggaagaaccccaagaacttccagaccatgcccggcatcttccagacgaccaccggcgagatcggggccatcgccctggacttcaagccgggcacctccgggagccccatcatcaaccgcgagggcaaggtggtgggcctgtacgggaacggcgtcgtgacgaagaacgggggctacgtgagcgggatcgcccagaccaacgccgagcccgacggcccgacccccgagctcgaggaggagatgttcaagaagcggaacctgaccatgatggacctgcaccccggctccgggaagacgcgcaagtacctccccgcgatcgtccgggaggccatcaagcgccggctgcgcaccctgatcctcgccccgacccgggtggtggccgccgagatggaggaggcgctgaagggcctgcccatccgctaccagaccacggccaccaagagcgagcacaccgggaaggagatcgtcgacctcatgtgccacgccaccttcacgatgcggctgctgtcccccgtgcgcgtgcccaactacaacctcatcatcatggacgaggcccacttcaccgacccggccagcatcgcggcccggggctacatctccacccgcgtcgggatgggcgaggccgccgcgatcttcatgaccgccacgccgcccggcaccgccgacgccttcccccagagcaacgccccgatccaggacgaggagcgggacatccccgagcgctcctggaacagcgggaacgactggatcaccgacttcgcgggcaagaccgtgtggttcgtgccctccatcaaggccgggaacgacatcgccaactgcctgcgcaagaacggcaagaaggtcatccagctgagccggaagacgttcgacaccgagtaccagaagaccaagctcaacgactgggacttcgtggtgaccacggacatctccgagatgggggccaacttcaaggccgaccgcgtcatcgacccccggcgctgcctgaagccggtgatcctgaccgacggccccgagcgggtgatcctcgcgggccccatgcccgtcaccgtggccagcgccgcccagcgccgggggcgcgtgggccggaacccgcagaaggagaacgaccagtacatcttcaccgggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccggctgaagggcgagagccgcaagaccttcgtcgagctcatgcggcgcggcgacctgcccgtgtggctggcgcacaaggtcgcctccgaggggatcaagtacaccgaccggaagtggtgcttcgacggcgagcgcaacaaccagatcctcgaggagaacatggacgtggagatctggaccaaggagggggagaagaagaagctgcggccccgctggctggacgcccggacgtacagcgaccccctcgccctgaaggagttcaaggacttcgccgcgggccgcaagtccatcgccctggacctcgtgaccgagatcggccgcgtcccgagccacctggcccaccggacccgcaacgccctggacaacctcgtgatgctgcacacctccgagcacgggggccgggcctaccgccacgcggtggaggagctgcccgagacgatggagaccctcctgctgctcgggctgatgatcctgctcaccggcggggccatgctgttcctgatcagcggcaagggcgtcgggaagaccagcatcggcctcatctgcgtggtggcctccagcgggatgctgtggatggccgacatccccctgcagtggatcgcctccgcgatcgtcctcgagttcttcatgatggtgctgctgatcccggagcccgagaagcagcggacgccccaggacaaccagctcgcctacgtggtcatcggcatcctgaccctggccgccatcgtggccgcgaacgagatggggctcctggagaccaccaagcgcgacctgggcatgagcaaggagcccggcgtggtctccccgacgagctacctcgacgtggacctgcaccccgcctccgcctggaccctgtacgccgtggcgaccaccgtcatcacgcccatgctccggcacaccatcgagaacagcaccgccaacgtgtccctggccgccatcgccaaccaggcggtggtcctgatggggctcgacaagggctggcccatcagcaagatggacctgggggtgccgctgctcgccctgggctgctactcccaggtgaaccccctgaccctcacggccgccgtcctgctgctcgtgacccactacgccatcatcgggcccggcctgcaggcgaaggccacccgcgaggcccagaagcggaccgccgccggcatcatgaagaaccccacggtggacgggatcatgaccatcgacctggacccggtcatctacgacagcaagttcgagaagcagctcggccaggtgatgctgctggtgctctgcgcggtccagctgctgctcatgcgcacctcctgggccttctgcgaggccctgaccctggccacggggcccatcaccaccctctgggagggcagccccggcaagttctggaacaccacgatcgcggtgtccatggccaacatcttccgggggagctacctggccggcgccgggctggccttctccatcatgaagtccgtgggcaccgggaagcgcggcaccggcagccagggggagaccctcggcgagaagtggaagaagaagctgaaccagctgagccggaaggagttcgacctctacaagaagtccgggatcacggaggtcgaccgcaccgaggcgaaggagggcctgaagcgcggggagatcacccaccacgccgtgtcccgcggcagcgccaagctgcagtggttcgtggagcggaacatggtcatccccgagggccgcgtgatcgacctcgggtgcggccgcgggggctggtcctactactgcgccgggctgaagaaggtgaccgaggtccgcggctacaccaagggcgggccgggccacgaggagcccgtgcccatgagcacgtacgggtggaacatcgtgaagctgatgtccggcaaggacgtcttctacctcccgcccgagaagtgcgacaccctgctgtgcgacatcggggagagctcccccagccccaccgtggaggagtcccggaccatccgcgtgctgaagatggtcgagccctggctcaagaacaaccagttctgcatcaaggtgctgaacccctacatgcccacggtgatcgagcacctggagcgcctccagcggaagcacggcggcatgctggtccgcaaccccctgagccggaactccacccacgagatgtactggatcagcaacgggaccggcaacatcgtgtccagcgtgaacatggtctcccgcctcctgctgaaccggttcaccatgacgtaccgccggcccaccatcgagaaggacgtggacctcggggccggcacccgccacgtcaacgcggagccggagacccccaacatggacgtgatcggcgagcggatccgccggatcaaggaggagcacagctccacgtggcactacgacgacgagaacccctacaagacctgggcctaccacgggagctacgaggtgaaggccaccggctccgccagcagcatgatcaacggggtcgtgaagctgctgaccaagccgtgggacgtggtccccacggtgacccagatggccatgaccgacaccacgcccttcggccagcagcgcgtgttcaaggagaaggtcgacacccggacccccaagccgatgcccgggacccgcaaggtgatggagatcacggcggagtggctctggcggaccctgggccgcaacaagcggccccgcctgtgcacccgggaggagttcaccaagaaggtgcgcacgaacgccgccatgggcgccgtcttcaccgaggagaaccagtgggactccgcgcgcgccgccgtggaggacgaggagttctggaagctcgtggaccgggagcgcgagctgcacaagctggggaagtgcggcagctgcgtctacaacatgatggggaagcgggagaagaagctcggcgagttcgggaaggccaagggctcccgcgccatctggtacatgtggctgggcgcgcggtacctggagttcgaggccctcgggttcctgaacgaggaccactggttcagccgcgagaactcctacagcggcgtggagggggagggcctgcacaagctcgggtacatcctgcgggacatctccaagatccccggcggcgccatgtacgccgacgacaccgccgggtgggacacccgcatcacggaggacgacctgcacaacgaggagaagatcacccagcagatggacccggagcaccggcagctcgcgaacgccatcttcaagctgacctaccagaacaaggtggtcaaggtgcagcgccccacccccaagggcacggtgatggacatcatcagccggaaggaccagcgcgggtccggccaggtcggcacctacgggctgaacaccttcaccaacatggaggcccagctcatccggcagatggagggcgagggggtgctgagcaagaccgacctggagaacccccacctcctggagaagaagatcacgcagtggctggagaccaagggcgtggagcgcctcaagcggatggccatctccggggacgactgcgtcgtgaagccgatcgacgaccgcttcgccaacgcgctgctggccctcaacgacatgggcaaggtgcggaaggacatcccccagtggcagcccagcaagggctggcacgactggcagcaggtccccttctgctcccaccacttccacgagctgatcatgaaggacgggcgcaagctggtggtgccgtgccggccccaggacgagctcatcggccgcgcccggatcagccagggggccggctggtccctgaaggagaccgcctgcctggggaaggcgtacgcccagatgtgggccctcatgtacttccaccgccgcgacctgcggctggccagcaacgcgatctgctccgccgtccccgtgcactgggtgcccaccagccgcacgacctggtccatccacgcccaccaccagtggatgaccaccgaggacatgctcacggtctggaaccgggtgtggatcgaggacaacccgtggatggaggacaaggcccccgtgaccacctgggaggacgtcccctacctgggcaagcgcgaggaccagtggtgcggcagcctgatcgggctcaccagccgggccacgtgggcgcagaacatcctgaccgccatccagcaggtccgctccctgatcggcaacgaggagttcctcgactacatgcccagcatgaagcggttccgcaaggaggaggagtccgagggggccatctggtga

SEQ ID NO: 9839 - RNA, 9873 nt, synthetic construct
  misc_feature 1..9873: note = derived and/or modified CDS sequence (opt1) from DENV-3__JN406514__SS-prME
  source 1..9873: mol_type = other RNA
accagcctgtgcctcatgatgatgctgcccgccaccctggccttccacctcaccagccgggacggggagccccggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcctggacctccccctgccctggacgagcggcgccaccaccgagcgccccacctggaaccggaaggagctgctcgtgacgttcaagaacgcccacgccaagaagcaggaggtggtcgtgctggggtcccaggagggcgccatgcacaccgcgctgaccggggccaccgagatccagaacagcggcgggacgtccatcttcgccggccacctcaagtgccgcctgaagatggacaagctggagctcaagggcatgagctacgccatgtgcctgaacaccttcgtgctgaagaaggaggtctccgagacccagcacgggaccatcctgatcaaggtggagtacaagggcgaggacgccccgtgcaagatccccttcagcacggaggacgggcagggcaaggcgcacaacggccggctcatcaccgccaaccccgtggtcaccaagaaggaggagcccgtgaacatcgaggccgagccgcccttcggggagagcaacatcgtgatcggcatcggggacaaggccctgaagatcaactggtacaagaagggctccagcatcgggaagatgttcgaggcgaccgcccgcggcgcccggcgcatggccatcctgggcgacacggcctgggacttcgggtccgtcggcggggtgctcaacagcctgggcaagatggtgcaccagatcttcgggtccgcgtacaccgccctgttcagcggcgtctcctggatcatgaagatcggcatcggggtgctcctgacctggatcggcctgaacagcaagaacacctccatgagcttctcctgcatcgtgatcgggatcatcacgctctacctgggcgccgtcgtgcaggccgacatggggtgcgtgatcaactggaagggcaaggagctgaagtgcggcagcgggatcttcgtcaccaacgaggtgcacacctggaccgagcagtacaagttccaggccgactcccccaagcgcctcgcgacggccatcgccggcgcctgggagaacggggtgtgcggcatccggagcaccacccgcatggagaacctgctgtggaagcagatcgccaacgagctcaactacatcctgtgggagaacaacatcaagctgaccgtcgtggtgggggacacgatcggcgtcctcgagcagggcaagcggaccctgacgccccagccgatggagctgaagtactcctggaagacctgggggaaggcgaagatcgtgacggccgagacccagaacagctccttcatcatcgacggccccaacacccccgagtgccccagcgcctcccgcgcctggaacgtgtgggaggtcgaggactacgggttcggcgtgttcagcaccaacatctggctcaagctgcgggaggtgtacacgcagagctgcgaccaccgcctgatgtccgcggccatcaaggacgagcgggccgtccacgccgacatgggctactggatcgagagccagaagaacgggtcctggaagctcgagaaggccagcttcatcgaggtgaagacctgcatctggccgaagtcccacaccctgtggagcaacggcgtgctggagtccgacatgatcatccccaagagcctcgcggggcccatctcccagcacaaccaccgcccgggctaccacacccagaccgccgggccctggcacctgggcaagctggagctcgacttcaactactgcgagggcacgaccgtcgtgatcaccgagaactgcgggacccggggccccagcctgcgcacgaccaccgtgtccgggaagctgatccacgagtggtgctgccggagctgcaccctgccgcccctgcgctacatgggcgaggacgggtgctggtacggcatggagatccggcccatcaacgagaaggaggagaacatggtcaagtccctggtgagcgccggctccgggaaggtggacaacttcacgatgggcgtcctctgcctggccatcctgttcgaggaggtgatgcgcgggaagttcggcaagaagcacatgatcgccggggtcctgttcaccttcgtcctgctgctcagcggccagatcacctggcgggacatggcgcacaccctgatcatgatcggctccaacgccagcgaccgcatggggatgggcgtgacgtacctggccctcatcgccaccttcaagatccagcccttcctggccctggggttcttcctccggaagctgaccagccgcgagaacctgctcctgggcgtgggcctggcgatggccaccacgctccagctgcccgaggacatcgagcagatggccaacgggatcgccctgggcctcatgaccctgaagctgatcacccagttcgagacctaccagctctggacggcgctggtctccctgacctgcagcaacaccatcttcaccctcacggtggcctggcggaccgccaccctgatcctggccggggtctccctcctgcccctgtgccagagctccagcatgcgcaagaccgactggctccccatgacggtggccgcgatgggcgtgccgcccctcccgctgttcatcttctccctcaaggacacccccaagcgccggagctggcccctgaacgagggggtcatggccgtgggcctggtgtccatcctcgccagctccctgctgcgcaacgacgtccccatggccggcccgctcgtggccgggggcctgctgatcgcgtgctacgtgatcaccgggaccagcgccgacctcacggtcgagaaggccgccgacgtgacctgggaggaggaggccgagcagaccggcgtgtcccacaacctgatgatcaccgtcgacgacgacgggacgatgcggatcaaggacgacgagaccgagaacatcctgaccgtgctcctgaagaccgcgctgctcatcgtgagcggcatcttcccctactccatccccgccaccctgctggtctggcacacgtggcagaagcagacccagcgcagcggcgtgctctgggacgtgccctccccgcccgagacccagaaggccgagctggaggagggggtctaccggatcaagcagcagggcatcttcgggaagacccaggtgggcgtgggggtccagaaggagggcgtgttccacacgatgtggcacgtgacccgcggcgccgtcctgacccacaacgggaagcggctcgagcccaactgggccagcgtgaagaaggacctgatctcctacggcgggggctggcgcctgagcgcgcagtggcagaagggggaggaggtgcaggtcatcgccgtggagcccggcaagaacccgaagaacttccagaccatgcccggcatcttccagacgaccaccggggagatcggcgccatcgccctggacttcaagcccgggaccagcggctccccgatcatcaaccgggagggcaaggtggtcgggctctacggcaacggggtggtgacgaagaacggcgggtacgtcagcggcatcgcgcagaccaacgccgagcccgacggccccacccccgagctggaggaggagatgttcaagaagcgcaacctgaccatcatggacctccacccggggtccggcaagacgcggaagtacctgcccgccatcgtgcgcgaggccatcaagcggcgcctgcggaccctcatcctggcccccacccgcgtggtcgcggccgagatggaggaggccctgaaggggctccccatccggtaccagaccacggccaccaagagcgagcacaccggccgcgagatcgtggacctgatgtgccacgccaccttcacgatgcggctgctctccccggtgcgcgtccccaactacaacctgatcatcatggacgaggcgcacttcaccgaccccgccagcatcgccgcccgggggtacatctccacccgcgtgggcatgggcgaggccgcggccatcttcatgaccgccacgcccccggggaccgccgaggcgttcccccagagcaacgcccccatccaggacgaggagcgcgacatccccgagcggtcctggaacagcggcaacgagtggatcaccgacttcgtggggaagaccgtctggttcgtgccgtccatcaaggccggcaacgacatcgccaactgcctgcgcaagaacgggaagaaggtgatccagctcagccggaagacgttcgacaccgagtaccagaagacccgcctgaacgactgggacttcgtcgtgaccacggacatctccgagatgggcgccaacttcaaggcggaccgggtgatcgacccccgccggtgcctgaagcccgtcatcctcaccgacggccccgagcgcgtgatcctggccgggccgatgcccgtgaccgccgccagcgccgcgcagcggcgcggccgggtcgggcgcaacccccagaaggagaacgaccagtacatcttcaccggccagcccctgaacaacgacgaggaccacgcccactggacggaggccaagatgctcctggacaacatcaacaccccggaggggatcatccccgccctgttcgagcccgagcgggagaagtccgccgcgatcgacggcgagtaccgcctcaagggcgagagccggaagaccttcgtggagctgatgcgccgcggggacctgcccgtctggctcgcccacaaggtggcctccgagggcatcaagtacaccgaccgcaagtggtgcttcgacggggagcggaacaaccagatcctggaggagaacatggacgtggagatctggaccaaggagggcgagcgcaagaagctgcgcccgcggtggctcgacgcccgcacgtacagcgaccccctggcgctgaaggagttcaaggacttcgccgccggccggaagtccatcgccctcgacctggtcaccgagatcgggcgcgtgcccagccacctggcccaccggacccgcaacgcgctcgacaacctggtgatgctgcacaccagcgagcacggcgggcgggcctaccgccacgccgtcgaggagctcccggagacgatggagaccctgctgctcctgggcctgatgatcctcctgaccgggggcgccatgctgttcctcatctccggcaaggggatcggcaagaccagcatcgggctgatctgcgtgatcgtgtccagcggcatgctgtggatggccgacgtccccctccagtggatcgcgtccgccatcgtgctggagttcttcatgatggtgctgctcatccccgagcccgagaagcagcggacgccgcaggacaaccagctggcctacgtcgtgatcgggatcctgaccctcgccgccatcgtggcggccaacgagatgggcctgctggagaccaccaagcgcgacctcggcatgagcaaggagcccggggtcgtgtcccccacgagctacctggacgtggacctgcaccccgcctccgcctggaccctctacgccgtcgcgaccaccgtgatcacgccgatgctgcggcacaccatcgagaacagcaccgccaacgtgtccctggccgccatcgcgaaccaggccgtcgtgctcatgggcctggacaaggggtggcccatcagcaagatggacctgggcgtgcccctcctggccctggggtgctactcccaggtcaaccccctcaccctgacggccgccgtgctgctcctggtgacccactacgcgatcatcggcccgggcctgcaggccaaggccacccgcgaggcccagaagcggaccgccgcggggatcatgaagaaccccacggtcgacggcatcatgaccatcgacctcgaccccgtgatctacgacagcaagttcgagaagcagctgggccaggtgatgctgctcgtcctgtgcgccgtgcagctgctcctgatgcgcacctcctgggccctgtgcgaggccctcaccctggccacgggccccatcaccaccctgtgggagggcagcccggggaagttctggaacaccacgatcgcggtgtccatggccaacatcttccggggcagctacctcgccggggccggcctggcgttctccatcatgaagtccgtcgggaccggccgccggggcaccgggagccagggcgagaccctgggggagaagtggaagaagaagctcaaccagctgtcccgcaaggagttcgacctgtacaagaagtccggcatcacggaggtggaccggaccgaggccaaggaggggctcaagcgcggcgagaccacccaccacgccgtgtcccggggcagcgccaagctgcagtggttcgtcgagcgcaacatggtgatccccgaggggcgcgtgatcgacctgggctgcgggcggggcgggtggtcctactactgcgccggcctcaagaaggtcaccgaggtgcgcggctacacgaagggcgggcccgggcacgaggagcccgtgccgatgagcacctacggctggaacatcgtcaagctgatgtccgggaaggacgtgttctacctgccgcccgagaagtgcgacaccctgctctgcgacatcggcgagagctcccccagcccgaccgtggaggagtcccggacgatccgcgtcctgaagatggtggagccctggctgaagaacaaccagttctgcatcaaggtgctcaacccctacatgcccaccgtcatcgagcacctggagcggctgcagcgcaagtacggcgggatgctcgtgcggaacccgctgagccgcaactccacccacgagatgtactggatcagcaacggcaccgggaacatcgtgtccagcgtcaacatggtgtcccggctgctcctgaaccgcttcacgatgacccaccggcgccccaccatcgagaaggacgtcgacctgggcgcgggcacccggcacgtgaacgccgagcccgagacgccgaacatggacgtgatcggggagcgcatcaagcggatcaaggaggagcacagctccacctggcactacgacgacgagaacccctacaagacctgggcctaccacggcagctacgaggtcaaggccaccgggagcgcctccagcatgatcaacggcgtggtgaagctcctgacgaagccctgggacgtcgtgcccatggtgacccagatggcgatgaccgacaccacgccgttcgggcagcagcgcgtcttcaaggagaaggtggacacccggacgccccggcccatgcccggcacccggaaggtgatggagatcacggccgagtggctgtggcgcaccctcggccgcaacaagaagccgcggctgtgcacccgcgaggagttcaccaagaaggtccggacgaacgccgccatgggggccgtgttcaccgaggagaaccagtgggactccgcgcgcgccgccgtggaggacgaggagttctggaagctggtcgaccgggagcgcgagctccacaagctgggcaagtgcgggagctgcgtgtacaacatgatgggcaagcgggagaagaagctgggggagttcggcaaggccaagggctcccgcgcgatctggtacatgtggctcggggcccggtacctggagttcgaggccctgggcttcctcaacgaggaccactggttcagccgcgagaactcctacagcggggtggagggcgaggggctgcacaagctgggctacatcctccgggacatctccaagatccccggcggggccatgtacgccgacgacaccgcgggctgggacacccgcatcacggaggacgacctgcacaacgaggagaagatcacccagcagatggaccccgagcacaagcagctggccaacgccatcttcaagctcacctaccagaacaaggtcgtgaaggtgcagcggcccaccccgaaggggacggtcatggacatcatcagccgcaaggaccagcggggctccggccaggtggggacctacggcctgaacaccttcaccaacatggaggcccagctggtgcgccagatggagggggagggcgtcctcagcaaggccgacctggagaacccccacctcctcgagaagaagatcacccagtggctggagacgaagggggtggagcggctgaagcgcatggcgatctccggcgacgactgcgtggtcaagcccatcgacgaccggttcgccaacgccctcctggccctgaacgacatgggcaaggtgcgcaaggacatcccccagtggcagccgagcaaggggtggcacgactggcagcaggtccccttctgctcccaccacttccacgagctcatcatgaaggacggccggaagctggtcgtgccctgccgcccccaggacgagctgatcgggcgcgcccggatcagccagggcgcggggtggtccctcaaggagaccgcctgcctgggcaaggcctacgcccagatgtggagcctgatgtacttccaccgccgggacctccgcctggcctccaacgcgatctgcagcgccgtgccggtccactgggtgcccaccagccggaccacgtggtccatccacgcccaccaccagtggatgaccaccgaggacatgctgaccgtgtggaaccgcgtctggatcgaggacaacccctggatggaggacaagacgcccgtgaccacctgggaggacgtgccgtacctcggcaagcgggaggaccagtggtgcgggagcctgatcggcctgacctcccgcgccacgtgggcgcagaacatcctcaccgccatccagcaggtccggagcctgatcggggacgaggagttcctggactacatgccctccatgaagcgcttccggaaggaggaggagagcgagggcgccatctggtga

SEQ ID NO: 9840 - RNA, 9873 nt, synthetic construct
  misc_feature 1..9873: note = derived and/or modified CDS sequence (opt1) from DENV-3__KT726340__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtgatcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccaccaagcgcgacctgggcatgtccaaggagccgggggtggtgagccccacgtcctacctggacgtcgacctccaccccgccagcgcctggaccctgtacgccgtggcgaccaccgtgatcacgcccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgcgaggcccagaagcggaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccggaccatccgcgtcctgaagatggtggagccgtggctcaagaacaaccagttctgcatcaaggtgctgaacccctacatgcccacggtcgtggagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccggctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccatcaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 9841 - RNA, 9873 nt, synthetic construct
  misc_feature 1..9873: note = derived and/or modified CDS sequence (opt1) from DENV-3__KT726345__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcatctgggaggaggaggccgagcagaccggcgtgagccacaacctgatgatcacggtggacgacgacgggaccatgcgcatcaaggacgacgagaccgagaacatcctcaccgtcctgctgaagaccgccctcctgatcgtgtccggcatcttcccgtacagcatccccgccacgctgctcgtgtggcacacctggcagaagcagacccagcggtccggcgtcctgtgggacgtgcccagcccgcccgagacccagaaggcggagctggaggagggggtgtaccgcatcaagcagcagggcatcttcgggaagacgcaggtcggcgtgggggtgcagaaggagggcgtcttccacaccatgtggcacgtgacccggggcgccgtgctcacccacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagacgatgcccggcaccttccagaccaccacgggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagaccaacgccgagccggacggccccacgcccgagctggaggaggagatgttcaagaagcggaacctcaccatcatggacctgcaccccgggagcggcaagacccgcaagtacctgccggcgatcgtccgggaggccatcaagcgccggctccgcaccctgatcctggcccccacgcgggtggtggccgccgagatggaggaggcgctcaaggggctgcccatccgctaccagaccaccgccaccaagtccgagcacacgggccgggagatcgtcgacctgatgtgccacgccaccttcaccatgcgcctcctgagccccgtgcgggtgccgaactacaacctgatcatcatggacgaggcccacttcaccgaccccgcctccatcgcggcccgcgggtacatcagcacgcgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcacggacttcgcggggaagaccgtgtggttcgtgcccagcatcaaggccggcaacgacatcgccaactgcctccggaagaacgggaagaaggtcatccagctgtcccgcaagaccttcgacaccgagtaccagaagacgaagctgaacgactgggacttcgtggtgaccaccgacatcagcgagatgggcgccaacttcaaggccgaccgggtcatcgacccgcgccggtgcctcaagcccgtgatcctgaccgacggccccgagcgcgtgatcctggcggggcccatgccggtcacggccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgcggccggccgcaagagcatcgccctggacctggtgaccgagatcgggcgggtgccctcccacctcgcccaccgcacgcggaacgccctggacaacctggtcatgctccacaccagcgagcacggcgggcgcgcgtaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcaccctggccgccatcatcgcggccaacgagatgggcctgctcgagacgaccaagcgggacctgggcatgtccaaggagccgggggtggtgagccccacctcctacctggacgtcgacctccaccccgccagcgcctggaccctgtacgcggtggccacgaccgtgatcacccccatgctgcgccacaccatcgagaactccacggccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacccactacgcgatcatcggccccggcctccaggccaaggccacgcgggaggcccagaagcgcaccgccgcggggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcggacgagctgggccctctgcgaggccctgaccctggcgaccggccccatcaccacgctctgggagggctcccccgggaagttctggaacaccaccatcgccgtgagcatggccaacatcttccgcggctcctacctggccggggccggcctggcgttcagcatcatgaagtccgtcgggaccggcaagcggggcacggggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcacggaggtgcggggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacccacgagatgtactggatctccaacggcacggggaacatcgtggcgagcgtcaacatggtgtcccggctcctgctgaaccgcttcaccatgacccaccggcgcccgaccatcgagaaggacgtggacctcggcgccggcacgcggcacgtcaacgccgagcccgagacccccaacatggacgtgatcggggagcgcatcaagcggatcaaggaggagcacaacagcacctggcactacgacgacgagaacccgtacaagacctgggcctaccacggctcctacgaggtgaaggccacggggagcgcgtccagcatgatcaacggcgtcgtgaagctgctgaccaagccctgggacgtcgtgcccatggtgacccagatggccatgaccgacacgacccccttcgggcagcagcgcgtcttcaaggagaaggtggacacccggaccccgcgcagcatgcccggcacgcggcgcgtgatgggcatcaccgccgagtggctctggcggaccctggggcgcaacaagaagccccggctgtgcacccgcgaggagttcacgaagaaggtccgcaccaacgccgcgatgggcgccgtgttcaccgaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacgcgcatcaccgaggacgacctgcacaacgaggagaagatcacccagcagatggacccggagcaccggcagctcgccaacgccatcttcaagctgacctaccagaacaaggtcgtgaaggtgcagcgccccacgcccaccggcaccgtcatggacatcatcagccggaaggaccagcgcggctccggccaggtgggcacctacgggctgaacaccttcacgaacatggaggcccagctcatccggcagatggagggcgagggggtgctgagcaaggcggacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcgcggatcagccagggggccggctggtccctccgcgagaccgcctgcctgggcaaggcctacgcgcagatgtggagcctgatgtacttccaccgccgggacctccgcctggcctccaacgccatctgcagcgccgtgcccgtgcactgggtcccgacgtcccggaccacctggagcatccacgcccaccaccagtggatgaccacggaggacatgctgaccgtgtggaaccgcgtgtggatcgaggacaacccctggatggaggacaagacccccgtcaccacgtgggagaacgtgccctacctcgggaagcgggaggaccagtggtgcggcagcctgatcgggctgacctcccgcgcgacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 9842 - RNA, 9873 nt, synthetic construct
  misc_feature 1..9873: note = derived and/or modified CDS sequence (opt1) from DENV-3__KT726349__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagtccatcctcaccgtcctgctgaagacggccctcctgatcgtgagcggcatcttcccgtactccatccccgccaccctgctcgtgtggcacacctggcagaagcagacccagcggagcggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgcacaacgggaagcgcctggagcccaactgggccagcgtcaagaaggacctgatctcctacggcgggggctggcggctcagcgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggctcccccatcatcaaccgcgagggcaaggtggtggggctgtacggcaacggggtcgtgaccaagaacggcgggtacgtgagcggcatcgcccagacgaacgccgagccggacggccccacccccgagctggaggaggagatgttcaagaagcggaacctcaccatcatggacctgcaccccgggtccggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccaccaagtccgagcacaccggccgggagatcgtcgacctgatgtgccacgccaccttcaccatgcgcctcctgtcccccgtgcgggtgccgaactacaacctgatcatcatggacgaggcccacttcacggaccccgccagcatcgcggcccgcgggtacatctccacccgggtcggcatgggcgaggccgccgcgatcttcatgaccgccacgccgcccgggacggccgacgccttcccgcagagcaacgcccccatccaggacgaggagcgcgacatccccgagcgctcctggaacagcggcaacgagtggatcaccgacttcgcggggaagaccgtgtggttcgtgccctccatcaaggccggcaacgacatcgccaactgcctccggaagaacgggaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacggccccgagcgcgtgatcctggcggggcccatgccggtcaccgccgccagcgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagagccggaagacgttcgtggagctgatgcgccgcggggacctccccgtctggctggcccacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctacagcgacccgctggccctcaaggagttcaaggacttcgcggccggccgcaagtccatcgccctggacctggtgacggagatcgggcgggtgcccagccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgagcaaggagccgggggtggtgtcccccaccagctacctggacgtcgacctccaccccgcctccgcctggacgctgtacgcggtggccaccaccgtgatcacccccatgctgcgccacacgatcgagaacagcaccgccaacgtctccctcgccgccatcgcgaaccaggccgtggtgctgatgggcctggacaaggggtggccgatcagcaagatggacctcggcgtccccctgctggccctcgggtgctactcccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgacagcaagttcgagaagcagctgggccaggtgatgctcctggtcctgtgcgccgtgcagctcctgctgatgcggacctcctgggccctctgcgaggccctgaccctggcgaccggccccatcacgaccctctgggagggcagccccgggaagttctggaacaccaccatcgccgtgtccatggccaacatcttccgcggcagctacctggccggggccggcctggcgttctccatcatgaagtccgtcgggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgccgtgtcccggggcagcgccaagctgcagtggttcgtcgagcgcaacatggtgatcccggaggggcgggtgatcgacctcggctgcgggcgcggcgggtggtcctactactgcgccggcctgaagaaggtcaccgaggtgcggggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacgcacgagatgtactggatcagcaacggcaccgggaacatcgtggcgtccgtcaacatggtgagccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtgaaggccaccgggtccgcgagcagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgctccatgcccggcacccggcgcgtgatgggcatcaccgccgagtggctctggcggaccctggggcgcaacaagaagccccggctgtgcacgcgcgaggagttcaccaagaaggtccgcaccaacgccgcgatgggcgccgtgttcaccgaggagaaccagtgggacagcgccaaggccgccgtggaggacgaggacttctggaagctcgtcgaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcggcagcggccaggtgggcacctacgggctgaacacgttcaccaacatggaggcccagctcatccggcagatggagggcgagggggtgctgtccaaggcggacctggagaacccccacctcccggagaagaagatcacccagtggctggagaccaagggcgtcgagcgcctgaagcggatggccatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcgcggatctcccagggggccggctggagcctccgcgagacggcctgcctgggcaaggcctacgcgcagatgtggtccctgatgtacttccaccgccgggacctccgcctggccagcaacgccatctgctccgccgtgcccgtgcactgggtcccgaccagccggaccacctggagcatccacgcccaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggctccctgatcgggctgaccagccgcgcgacctgggcccagaacatcccgacggccatccagcaggtccggtccctcatcggcaacgaggagttcctggactacatgcccagcatgaagcgcttccggaaggaggaggagtccgagggggccatctggtga

SEQ ID NO: 9843 - RNA, 9873 nt, synthetic construct
  misc_feature 1..9873: note = derived and/or modified CDS sequence (opt1) from DENV-3__KT726347__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcgccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacatggggtgcgtgatcaactggaagggcaaggagctgaagtgcggcagcgggatcttcgtgaccaacgaggtccacacgtggaccgagcagtacaagttccaggccgactcccccaagcgcctcgccaccgccatcgccggcgcgtgggagaacggggtgtgcggcatccgcagcaccacgcggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacgtgggggaaggccaagatcgtcaccgccgagacccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgaccggatggggatgggcgtgacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatcttcaccctgaccgtcgcctggcgcaccgcgacgctgatcctcgccggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggcggtgggcctcgtgagcatcctggcctccagcctgctccggaacgacgtccccatggccggccccctggtggccgggggcctgctcatcgcctgctacgtgatcaccgggacgtccgcggacctgaccgtcgagaaggccgccgacatcacctgggaggaggaggccgagcagaccggcgtgagccacaacctgatgatcacggtggacgacgacgggaccatgcgcatcaaggacgacgagaccgagaacatcctcaccgtcctgctgaagaccgccctcctgatcgtgtccggcatcttcccgtacagcatccccgcgacgctgctcgtgtggcacacctggcagaagcagacccagcggtccggcgtcctgtgggacgtgcccagcccgcccgagacccagaaggccgagctggaggagggggtgtaccgcatcaagcagcagggcatcttcgggaagacgcaggtcggcgtgggggtgcagaaggagggcgtcttccacaccatgtggcacgtgacccggggcgccgtgctcacccacaacgggaagcgcctggagcccaactgggcctccgtcaagaaggacctgatcagctacggcgggggctggcggctctccgcgcagtggcagaagggggaggaggtccaggtgatcgccgtcgagcccggcaagaaccccaagaacttccagacgatgcccggcaccttccagaccaccacgggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagaccaacgcggagccggacggccccacgcccgagctggaggaggagatgttcaagaagcggaacctcaccatcatggacctgcaccccgggagcggcaagacccgcaagtacctgccggccatcgtccgggaggccatcaagcgccggctccgcaccctgatcctggcccccacgcgggtggtggccgcggagatggaggaggccctcaaggggctgcccatccgctaccagaccaccgccaccaagtccgagcacacgggccgggagatcgtcgacctgatgtgccacgccaccttcaccatgcgcctcctgagccccgtgcgggtgccgaactacaacctgatcatcatggacgaggcccacttcaccgaccccgcgtccatcgccgcccgcgggtacatcagcacgcgggtcggcatgggcgaggccgcggccatcttcatgaccgccacgccgcccgggaccgccgacgccttcccgcagtccaacgcgcccatccaggacgaggagcgcgacatccccgagcgcagctggaactccggcaacgagtggatcacggacttcgccgggaagaccgtgtggttcgtgcccagcatcaaggccggcaacgacatcgccaactgcctccggaagaacgggaagaaggtcatccagctgtcccgcaagaccttcgacaccgagtaccagaagacgaagctgaacgactgggacttcgtggtgaccaccgacatcagcgagatgggcgccaacttcaaggcggaccgggtcatcgacccgcgccggtgcctcaagcccgtgatcctgaccgacggccccgagcgcgtgatcctggccgggcccatgccggtcacggccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagaccttcgtggagctgatgcgccgcggggacctccccgtctggctggcccacaaggtggccagcgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggcgctcaaggagttcaaggacttcgccgccggccgcaagagcatcgccctggacctggtgaccgagatcgggcgggtgccctcccacctcgcccaccgcacgcggaacgcgctggacaacctggtcatgctccacaccagcgagcacggcgggcgcgcctaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcgcacgccccaggacaaccagctggcctacgtggtcatcgggatcctcaccctggccgcgatcatcgccgccaacgagatgggcctgctcgagacgaccaagcgggacctgggcatgtccaaggagccgggggtggtgagccccacctcctacctggacgtcgacctccaccccgccagcgcgtggaccctgtacgccgtggccacgaccgtgatcacccccatgctgcgccacaccatcgagaactccacggccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacccactacgccatcatcggccccggcctccaggccaaggccacgcgggaggcccagaagcgcaccgcggccgggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcggacgagctgggccctctgcgaggcgctgaccctggccaccggccccatcaccacgctctgggagggctcccccgggaagttctggaacaccaccatcgccgtgagcatggccaacatcttccgcggctcctacctggccggggcgggcctggccttcagcatcatgaagtccgtcgggaccggcaagcggggcacggggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcacggaggtgcggggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacccacgagatgtactggatctccaacggcacggggaacatcgtggccagcgtcaacatggtgtcccggctcctgctgaaccgcttcaccatgacccaccggcgcccgaccatcgagaaggacgtggacctcggcgccggcacgcggcacgtcaacgccgagcccgagacccccaacatggacgtgatcggggagcgcatcaagcggatcaaggaggagcacaacagcacctggcactacgacgacgagaacccgtacaagacctgggcctaccacggctcctacgaggtgaaggcgacggggagcgcctccagcatgatcaacggcgtcgtgaagctgctgaccaagccctgggacgtcgtgcccatggtgacccagatggccatgaccgacacgacccccttcgggcagcagcgcgtcttcaaggagaaggtggacacccggaccccgcgcagcatgcccggcacgcggcgcgtgatgggcatcaccgccgagtggctctggcggaccctggggcgcaacaagaagccccggctgtgcacccgcgaggagttcacgaagaaggtccgcaccaacgcggccatgggcgccgtgttcaccgaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacaccgccgggtgggacacgcgcatcaccgaggacgacctgcacaacgaggagaagatcacccagcagatggacccggagcaccggcagctcgccaacgccatcttcaagctgacctaccagaacaaggtcgtgaaggtgcagcgccccacgcccaccggcaccgtcatggacatcatcagccggaaggaccagcgcggctccggccaggtgggcacctacgggctgaacaccttcacgaacatggaggcgcagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggcgctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctccgcgagaccgcctgcctgggcaaggcgtacgcccagatgtggagcctgatgtacttccaccgccgggacctccgcctggcctccaacgccatctgcagcgccgtgcccgtgcactgggtcccgacgtcccggaccacctggagcatccacgcgcaccaccagtggatgaccacggaggacatgctgaccgtgtggaaccgcgtgtggatcgaggacaacccctggatggaggacaagacccccgtcaccacgtgggagaacgtgccctacctcgggaagcgggaggaccagtggtgcggcagcctgatcgggctgacctcccgcgccacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 9844 - RNA, 9873 nt, synthetic construct
  misc_feature 1..9873: note = derived and/or modified CDS sequence (opt1) from DENV-3__KT726352__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgcacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgtccaaggagccgggggtggtgagccccacctcctacctggacgtcgacctccaccccgccagcgcctggacgctgtacgcggtggccaccaccgtgatcacccccatgctgcgccacacgatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggcgagcgtcaacatggtgtcccggctcctgctgaaccgcttcaccatgacccaccggcgcccggccatcgagaaggacgtggacctcggcgccggcacgcggcacgtcaacgccgagcccgagacccccaacatggacgtgatcggggagcgcatcaagcggatcaaggaggagcacaacagcacctggcactacgacgacgagaacccgtacaagacctgggcctaccacggctcctacgaggtgaaggcgacggggagcgcctccagcatgatcaacggcgtcgtgaagctgctgaccaagccctgggacgtcgtgcccatggtgacccagatggccatgaccgacacgacccccttcgggcagcagcgcgtcttcaaggagaaggtggacacccggaccccgcgcagcatgcccggcacgcggcgcgtgatgggcatcaccgccgagtggctctggcggaccctggggcgcaacaagaagccccggctgtgcacccgcgaggagttcacgaagaaggtccgcaccaacgcggccatgggcgccgtgttcaccgaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacaccgccgggtgggacacgcgcatcaccgaggacgacctgcacaacgaggagaagatcacccagcagatggacccggagcaccggcagctcgccaacgccatcttcaagctgacctaccagaacaaggtcgtgaaggtgcagcgccccacgcccaccggcaccgtcatggacatcatcagccggaaggaccagcgcggctccggccaggtgggcacctacgggctgaacaccttcacgaacatggaggcgcagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggcgctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctccgcgagaccgcctgcctgggcaaggcgtacgcccagatgtggagcctgatgtacttccaccgccgggacctccgcctggcctccaacgccatctgcagcgccgtgcccgtgcactgggtcccgacgtcccggaccacctggagcatccacgcgcaccaccagtggatgaccacggaggacatgctgaccgtgtggaaccgcgtgtggatcgaggacaacccctggatggaggacaagacccccgtcaccacgtgggagaacgtgccctacctcgggaagcgggaggaccagtggtgcggcagcctgatcgggctgacctcccgcgccacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 9845 - RNA, 9873 nt, synthetic construct
  misc_feature 1..9873: note = derived and/or modified CDS sequence (opt1) from DENV-3__KT726356__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctgccgctgttcatcttcagcctcaaggacaccctgaagcgccgctcctggcccctgaacgagggggtcatggccgtgggcctcgtgagcatcctggcgtccagcctgctccggaacgacgtccccatggccggccccctgctggccgggggcctcctgatcgcctgctacgtgatcacggggacctccgccgacctgaccgtggagaaggcggccgacatcacctgggaggaggaggccgagcagacgggcgtcagccacaacctcatgatcaccgtggacgacgacgggaccatgcgcatcaaggacgacgagaccgagaacatcctgaccgtgctgctcaagacggccctgctgatcgtctccggcatcttcccgtacagcatccccgccaccctcctggtgtggcacacctggcagaagcagacccagcggtccggcgtgctgtgggacgtccccagcccgcccgagacgcagaaggcggagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggcctccgtgaagaaggacctcatcagctacggcgggggctggcggctgtccgcccagtggcagaagggggaggaggtccaggtgatcgcggtggagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctcgaggaggagatgttcaagaagcggaacctgaccatcatggacctgcaccccgggagcggcaagacccgcaagtacctcccggcgatcgtgcgggaggccatcaagcgccggctgcgcacgctgatcctcgcccccacccgggtcgtggccgccgagatggaggaggcgctgaaggggctgcccatccgctaccagaccaccgccacgaagtccgagcacaccggccgggagatcgtggacctcatgtgccacgccaccttcaccatgcgcctgctgagccccgtccgggtgccgaactacaacctcatcatcatggacgaggcccacttcacggaccccgcctccatcgcggcccgcgggtacatcagcacccgggtgggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtctggttcgtgcccagcatcaaggccggcaacgacatcgccaactgcctgcggaagaacgggaagaaggtgatccagctgtcccgcaagaccttcgacacggagtaccagaagaccaagctcaacgactgggacttcgtcgtgaccaccgacatcagcgagatgggcgccaacttcaaggccgaccgggtgatcgacccgcgccggtgcctgaagcccgtcatcctgacggacggccccgagcgcgtgatcctcgcggggcccatgccggtgaccgccgcctccgccgcccagcggcgcggccgggtcgggcgcaacccccagaaggagaacgaccagtacatcttcaccggccagcccctgaacaacgacgaggaccacgcgcactggaccgaggccaagatgctgctcgacaacatcaacacccccgaggggatcatcccggccctgttcgagcccgagcgggagaagtccgccgcgatcgacggcgagtaccgcctgaagggcgagtcccggaagacgttcgtggagctcatgcgccgcggggacctgcccgtgtggctggcccacaaggtcgccagcgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacctactccgacccgctcgccctgaaggagttcaaggacttcgcggccggccgcaagagcatcgccctggacctcgtcacggagatcgggcgggtgccctcccacctggcccaccgcacccggaacgccctggacaacctcgtgatgctgcacaccagcgagcacggcgggcgcgcgtaccggcacgccgtcgaggagctgcccgagaccatggagacgctcctgctgctcggcctgatgatcctgctcaccgggggcgccatgctgttcctgatcagcggcaaggggatcggcaagacctccatcgggctcatctgcgtgatcgccagctccggcatgctgtggatggccgagatcccgctgcagtggatcgcgagcgccatcgtgctcgagttcttcatgatggtcctgctgatccccgagcccgagaagcagcgcacgccccaggacaaccagctcgcctacgtggtgatcgggatcctgacgctggccgccatcatcgcggccaacgagatgggcctcctggagaccaccaagcgggacctgggcatgtccaaggagccgggggtcgtgagccccacctcctacctcgacgtggacctgcaccccgccagcgcctggacgctgtacgcggtcgccaccaccgtgatcacccccatgctccgccacacgatcgagaactccaccgccaacgtgagcctggccgccatcgcgaaccaggccgtcgtgctgatgggcctcgacaaggggtggccgatctccaagatggacctgggcgtgcccctgctcgccctggggtgctacagccaggtcaaccccctgaccctcaccgccgccgtgctgctgctcatcacgcactacgcgatcatcggccccggcctgcaggccaaggccacccgggaggcccagaagcgcaccgccgcggggatcatgaagaacccgaccgtggacggcatcatgacgatcgacctggaccccgtcatctacgactccaagttcgagaagcagctcggccaggtgatgctgctggtgctctgcgccgtccagctgctgctcatgcggaccagctgggccctgtgcgaggccctgaccctcgcgaccggccccatcacgaccctgtgggagggctcccccgggaagttctggaacaccaccatcgccgtgagcatggccaacatcttccgcggctcctacctggccggggccggcctcgcgttcagcatcatgaagtccgtggggacgggcaagcggggcaccgggagccagggcgagaccctgggggagaagtggaagaagaagctgaaccagctcagccgcaaggagttcgacctgtacaagaagtccggcatcaccgaggtcgaccggaccgaggccaaggaggggctgaagcgcggcgagatcacgcaccacgccgtgagccggggctccgccaagctccagtggttcgtggagcgcaacatggtcatcccggaggggcgggtgatcgacctgggctgcgggcgcggcgggtggagctactactgcgccggcctgaagaaggtgaccgaggtccggggctacaccaagggcgggcccgggcacgaggagcccgtgcccatgtccacctacggctggaacatcgtgaagctcatgagcgggaaggacgtcttctacctgccgcccgagaagtgcgacacgctgctgtgcgacatcggcgagtccagcccctcccccaccgtggaggagagccgcaccatccgcgtgctcaagatggtcgagccgtggctgaagaacaaccagttctgcatcaaggtgctgaacccctacatgcccaccgtgatcgagcacctcgagcggctgcagcgcaagcacggcgggatgctggtccggaaccccctctcccgcaacagcacgcacgagatgtactggatctccaacggcaccgggaacatcgtggcgagcgtgaacatggtctcccggctgctgctcaaccgcttcaccatgacctaccggcgcccgacgatcgagaaggacgtggacctgggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtggtcaagctgctcaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgccgagtggctgtggcggaccctggggcgcaacaagaagccccggctctgcacgcgcgaggagttcaccaagaaggtgcgcaccaacgccgcgatgggcgccgtcttcaccgaggagaaccagtgggactccgccaaggccgccgtggaggacgaggacttctggaagctggtggaccgggagcgcgagctgcacaagctcgggaagtgcggcagctgcgtctacaacatgatggggaagcgggagaagaagctgggcgagttcggcaaggcgaaggggtcccgcgccatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgccatgtacgcggacgacacggccgggtgggacacccgcatcaccgaggacgacctccacaacgaggagaagatcacccagcagatggacccggagcaccggcagctggccaacgccatcttcaagctgacgtaccagaacaaggtggtcaaggtgcagcgccccacccccaccggcaccgtgatggacatcatcagccggaaggaccagcgcggctccgggcaggtcggcacctacgggctcaacacgttcaccaacatggaggcccagctgatccggcagatggagggcgagggggtgctgagcaaggcggacctcgagaacccccacctccccgagaagaagatcacccagtggctggagaccaagggcgtggagcgcctgaagcggatggccatctccggcgacgactgcgtcgtgaagcccatcgacgaccgcttcgccaacgccctgctggccctcaacgacatggggaaggtgcggaaggacatcccccagtggcagcccagcaagggctggcacgactggcagcaggtcccgttctgctcccaccacttccacgagctgatcatgaaggacgggcgcaagctggtggtgccctgccggccccaggacgagctcatcggccgcgcgcggatcagccagggggccggctggtccctgcgcgagacggcctgcctgggcaaggcctacgcgcagatgtggagcctcatgtacttccaccgccgggacctgcgcctggcctccaacgccatctgcagcgccgtccccgtgcactgggtgccgacctcccggaccacctggagcatccacgcccaccaccagtggatgacgaccgaggacatgctcaccgtctggaaccgcgtgtggatcgaggacaacccctggatggaggacaagacccccgtgacgacctgggagaacgtcccctacctggggaagcgggaggaccagtggtgcggcagcctgatcgggctcacctcccgcgcgacctgggcccagaacatcccgacggccatccagcaggtccggagcctgatcggcaacgaggagttcctggactacatgccctccatgaagcgcttccggaaggaggaggagagcgagggggccatctggtga

SEQ ID NO: 9846 - RNA, 9873 nt, synthetic construct
  misc_feature 1..9873: note = derived and/or modified CDS sequence (opt1) from DENV-3__KT726342__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgcacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgtccaaggagccgggggtggtgagccccacctcctacctggacgtcgacctccaccccgccagcgcctggacgctgtacgcggtggccaccaccgtgatcacccccatgctgcgccacacgatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggcgagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgccgagtggctctggcggaccctggggcgcaacaagaagccccggctgtgcacgcgcgaggagttcaccaagaaggtccgcaccaacgccgcgatgggcgccgtgttcaccgaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggcggacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcgcggatcagccagggggccggctggtccctccgcgagacggcctgcctgggcaaggcctacgcgcagatgtggagcctgatgtacttccaccgccgggacctccgcctggcctccaacgccatctgcagcgccgtgcccgtgcactgggtcccgacctcccggaccacctggagcatccacgcccaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggcagcctgatcgggctgacctcccgcgcgacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 9847 - RNA, 9873 nt, synthetic construct
  misc_feature 1..9873: note = derived and/or modified CDS sequence (opt1) from DENV-3__KT726343__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgcgaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgccgtgctcacgcacaacgggaagcgcctggagcccaactgggcctccgtgaagaaggacctgatcagctacggcgggggctggcggctctccgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgcggagccggacggccccacccccgagctggaggaggagatgttcaagaagcggaacctcaccatcatggacctgcaccccgggagcggcaagacccgcaagtacctgccggccatcgtgcgggaggccatcaagcgccggctccgcacgctgatcctggcccccacccgggtcgtggccgcggagatggaggaggccctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcgtccatcgccgcccgcgggtacatcagcacccgggtgggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtctggttcgtgcccagcatcaaggccggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggcggaccgggtgatcgacccgcgccggtgcctcaagcccgtcatcctgacggacggccccgagcgcgtgatcctggccgggcccatgccggtgaccgccgcctccgccgcgcagcggcgcggccgggtcgggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtcacggagatcgggcgggtgccctcccacctcgcccaccgcacccggaacgcgctggacaacctggtgatgctccacaccagcgagcacggcgggcgcgcctaccggcacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcgcacgccccaggacaaccagctggcctacgtggtgatcgggatcctcacgctggccgcgatcatcgccgccaacgagatgggcctgctcgagaccaccaagcgggacctgggcatgtccaaggagccgggggtcgtgagccccacctcctacctggacgtggacctccaccccgccagcgcgtggacgctgtacgccgtcgccaccaccgtgatcacccccatgctgcgccacacgatcgagaactccaccgccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtcatctacgactccaagttcgagaagcagctgggccaggtgatgctcctggtgctgtgcgccgtccagctcctgctgatgcggaccagctgggccctctgcgaggcgctgaccctggccaccggccccatcacgaccctctgggagggctcccccgggaagttctggaacaccaccatcgccgtgagcatggccaacatcttccgcggctcctacctggccggggcgggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagatcacgcaccacgccgtgagccggggctccgccaagctgcagtggttcgtggagcgcaacatggtcatcccggaggggcgggtgatcgacctcggctgcgggcgcggcgggtggagctactactgcgcgggcctgaagaaggtgaccgaggtccggggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggccagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggactccgccaaggccgcggtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcgcagctcatccggcagatggagggcgagggggtgctgagcaaggccgacctggagaacccccacctcccggagaagaagatcacccagtggctggagaccaagggcgtggagcgcctgaagcggatggccatctccggcgacgactgcgtcgtgaagcccatcgacgaccgcttcgccaacgccctcctggcgctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagacggcctgcctgggcaaggcgtacgcccagatgtggagcctgatgtacttccaccgccgggacctccgcctggcctccaacgccatctgcagcgccgtccccgtgcactgggtgccgacctcccggaccacctggagcatccacgcgcaccaccagtggatgacgaccgaggacatgctgaccgtctggaaccgcgtgtggatcgaggacaacccctggatggaggacaagacccccgtgacgacctgggagaacgtcccctacctcgggaagcgggaggaccagtggtgcggcagcctgatcgggctgacctcccgcgccacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 9848 - RNA, 9873 nt, synthetic construct
  misc_feature 1..9873: note = derived and/or modified CDS sequence (opt1) from DENV-3__KT726351__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgcacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgtccaaggagccgggggtggtgagccccacctcctacctggacgtcgacctccaccccgccagcgcctggacgctgtacgcggtggccaccaccgtgatcacccccatgctgcgccacacgatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggcgagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggaaggtgatgggcatcaccgccgagtggctctggcgcaccctggggcggaacaagaagccccgcctgtgcacgcgggaggagttcaccaagaaggtccgcaccaacgccgcgatgggcgccgtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacacggccgggtgggacacccggatcaccgaggacgacctgcacaacgaggagaagatcacccagcagatggacccggagcaccgccagctcgccaacgccatcttcaagctgacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcccagctcatccgccagatggagggcgagggggtgctgagcaaggcggacctggagaacccccacctcccggagaagaagatcacccagtggctggagaccaagggcgtcgagcggctgaagcgcatggccatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcgcgcatcagccagggggccggctggtccctccgggagacggcctgcctgggcaaggcctacgcgcagatgtggagcctgatgtacttccaccgccgcgacctccggctggcctccaacgccatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggcgacctgggcccagaacatcccgacggccatccagcaggtccgcagcctcatcggcaacgaggagttcctggactacatgccctccatgaagcggttccgcaaggaggaggagagcgagggggccatctggtga

SEQ ID NO: 9849 - RNA, 9873 nt, synthetic construct
  misc_feature 1..9873: note = derived and/or modified CDS sequence (opt1) from DENV-3__KT726360__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgcacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgtccaaggacccgggggtggtgagccccacctcctacctggacgtcgacctccaccccgccagcgcctggacgctgtacgcggtggccaccaccgtgatcacccccatgctgcgccacacgatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggcgagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgccgagtggctctggcggaccctggggcgcaacaagaagccccggctgtgcacgcgcgaggagttcaccaagaaggtccgcaccaacgccgcgatgggcgccgtgttcaccgaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggcggacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcgcggatcagccagggggccggctggtccctccgcgagacggcctgcctgggcaaggcctacgcgcagatgtggagcctgatgtacttccaccgccgggacctccgcctggcctccaacgccatctgcagcgccgtgcccgtgcactgggtcccgacctcccggaccacctggagcatccacgcccaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggcagcctgatcgggctgacctcccgcgcgacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 9850 - RNA, 9873 nt, synthetic construct
  misc_feature 1..9873: note = derived and/or modified CDS sequence (opt1) from DENV-3__KF041259__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaacgaggtggagcccgaggacatcgactgctggtgcaacctgacgagcacctgggtgacctacgggacctgcaaccaggccggcgagcaccggcgcgacaagcggtccgtggccctcgcgccccacgtgggcatggggctggacacgcgcacccagacctggatgagcgccgagggcgcctggcgccaggtggagaaggtggagacctgggccctgcgccacccggggttcacgatcctcgcgctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggccacccagctggcgaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggccagcacgaccgaggcgatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgccaagaagcaggaggtcgtggtgctggggtcccaggagggcgcgatgcacaccgccctcaccggggccacggagatccagaacagcggcgggacctccatcttcgccggccacctgaagtgccggctgaagatggacaagctcgagctgaagggcatgagctacgccatgtgcaccaacaccttcgtcctgaagaaggaggtgtccgagacgcagcacgggaccatcctcatcaaggtggagtacaagggcgaggacgcgccgtgcaagatccccttcagcaccgaggacgggcagggcaaggcccacaacggccgcctgatcaccgccaaccccgtcgtgacgaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacgtggaccgagcagtacaagttccaggccgactcccccaagcgcctcgccaccgccatcgccggcgcgtgggagaacggggtctgcggcatccgcagcaccacgcggatggagaacctgctgtggaagcagatcgccaacgagctcaactacatcctgtgggagaacaacatcaagctgaccgtggtggtcggggacaccatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggccgggcccatctcccagcacaactaccggccgggctaccacacccagaccgccgggccctggcacctgggccgcctcgagctggacttcaactactgcgagggcacgaccgtggtcatcaccgagaactgcgggacccggggccccagcctgcgcacgaccaccgtgtccgggaagctcatccacgagtggtgctgccggagctgcaccctgcccccgctgcgctacatgggcgaggacgggtgctggtacggcatggagatccggcccatctccgagaaggaggagaacatggtcaagagcctcgtctccgccggcagcgggaaggtggacaacttcacgatgggcgtgctgtgcctggcgatcctcttcgaggaggtcatgcgcgggaagttcggcaagaagcacatgatcgccggggtgttcttcaccttcgtgctgctgctctccggccagatcacctggcgggacatggcccacaccctgatcatgatcggcagcaacgcctccgaccgcatggggatgggcgtcacgtacctggccctcatcgcgaccttcaagatccagcccttcctggccctggggttcttcctccggaagctgaccagccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatcagcctgacgtgctccaacaccatcttcaccctcaccgtggcctggcggacggcgaccctgatcctggccggggtcagcctcctgccggtgtgccagtccagctccatgcgcaagaccgactggctgcccatgaccgtcgccgccatgggcgtgccgcccctcccgctgttcatcttcagcctgaaggacacgctcaagcgccggtcctggcccctgaacgagggggtgatggccgtcggcctggtgagcatcctcgcgtccagcctgctgcgcaacgacgtgcccatggccggccccctcgtcgccgggggcctgctgatcgcctgctacgtgatcaccgggacctccgccgacctcaccgtggagaaggcggccgacgtcacgtgggaggaggaggccgagcagaccggcgtgagccacaacctgatgatcaccgtggacgacgacgggaccatgcggatcaaggacgacgagaccgagaacatcctgacggtcctcctgaagaccgccctgctcatcgtgtccggcatcttcccgtacagcatccccgccaccctgctggtgtggcacacctggcagaagcagacgcagcgctccggcgtcctctgggacgtgcccagcccgcccgagacccagaaggcggagctggaggagggggtgtaccggatcaagcagcagggcatcctggggaagacccaggtcggcgtgggggtgcagaaggagggcgtcttccacaccatgtggcacgtgacgcgcggcgccgtgctcacccacaacgggaagcggctggagcccaactgggcctccgtcaagaaggacctgatcagctacggcgggggctggcgcctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgggagggcaaggtggtggggctgtacggcaacggggtcgtgacgaagaacggcgggtacgtgtccggcatcgcccagaccaacgccgagccggacggccccacccccgagctggaggaggagatgttcaagaagcgcaacctcaccatcatggacctgcaccccgggagcggcaagacgcggaagtacctgccggcgatcgtccgcgaggccatcaagcggcgcctccggaccctgatcctggcccccacccgcgtggtggccgccgagatggaggaggcgctcaaggggctgcccatccggtaccagaccacggccaccaagtccgagcacaccggccgcgagatcgtcgacctgatgtgccacgccaccttcacgatgcggctcctgagccccgtgcgcgtgccgaactacaacctgatcatcatggacgaggcccacttcaccgaccccgcctccatcgcggcccgggggtacatcagcacccgcgtcggcatgggcgaggccgccgcgatcttcatgaccgccacgccgcccgggaccgccgacgccttcccgcagtccaacgcccccatccaggacgaggagcgcgacatccccgagcggagctggaactccggcaacgagtggatcaccgacttcgcggggaagaccgtgtggttcgtgcccagcatcaaggccggcaacgacatcgccaactgcctccgcaagaacgggaagaaggtcatccagctgtcccggaagacgttcgacaccgagtaccagaagaccaagctgaacgactgggacttcgtggtgaccacggacatcagcgagatgggcgccaacttcaaggccgaccgcgtcatcgacccgcggcgctgcctcaagcccgtgatcctgaccgacggccccgagcgggtgatcctggcggggcccatgccggtcaccgccgcctccgccgcccagcgccggggccgcgtggggcggaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgcgagaagtccgccgcgatcgacggcgagtaccggctgaagggcgagtcccgcaagaccttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtcgagatctggaccaaggagggcgagaagcggaagctccgcccccgctggctggacgcccggacgtactccgacccgctggccctcaaggagttcaaggacttcgcggccggccgcaagagcatcgccctggacctggtgaccgagatcgggcgggtgccctcccacctcgcccaccgcacccggaacgccctggacaacctggtcatgctccacaccagcgagcacggcgggcgcgcgtaccggcacgccgtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcaccctggccgccatcatcgcggccaacgagatgggcctgctcgagaccaccaagcgggacctgggcatgtccaaggagccgggggtggtgagccccacgtcctacctggacgtcgacctccaccccgccagcgcctggaccctgtacgcggtggccaccaccgtgatcacgcccatgctgcgccacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgacggccgccgtgctcctgctgatcacccactacgcgatcatcggccccggcctccaggccaaggccacccgggaggcccagaagcgcaccgccgcggggatcatgaagaacccgacggtcgacggcatcatcaccatcgacctggaccccgtgatctacgactccaagttcgagaagcagctgggccaggtgatgctcctggtcctgtgcgccgtgcagctcctgctgatgcggaccagctgggccctctgcgaggccctgaccctggcgacgggccccatcaccaccctctgggagggctcccccgggaagttctggaacaccacgatcgccgtgagcatggccaacatcttccgcggctcctacctggccggggccggcctggcgttcagcatcatgaagtccgtcgggaccggcaagcggggcaccgggagccagggcgagaccctcggggagaagtggaagaagaagctgaaccagctgagccgcaaggagttcgacctctacaagaagtccggcatcaccgaggtggaccggacggaggccaaggaggggctgaagcgcggcgagaccacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccggacgatccgcgtcctgaagatggtggagccgtggctcaagaacaaccagttctgcatcaaggtgctgaacccctacatgcccgcggtcatcgagcacctggagcggctccagcgcaagcacggcgggatgctggtgcggaaccccctgtcccgcaacagcacccacgagatgtactggatctccaacggcaccgggaacatcgtgagctccgtcaacatggtgagccggctcctgctgaaccgcttcaagatgacccaccggcgcccgacgatcgagaaggacgtggacctcggcgccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtgaaggccaccgggtccgcgagcagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgccccatgcccggcacccggaaggtgatggagatcaccgccgagtggctctggcgcaccctgggccggaacaagcgcccccgcctgtgcacgcgggaggagttcaccaagaaggtccgcaccaacgccgcgatgggggccgtgttcaccgaggagaaccagtgggactccgccaaggccgccgtggaggacgaggagttctggaagctcgtcgaccgggagcgcgagctgcacaagctgggcaagtgcgggagctgcgtgtacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatcccgggcggggccatgtacgcggacgacacggccggctgggacacccgcatcaccgaggacgacctgcacaacgaggagaagatcacccagcagatggaccccgagcaccggctcctggccaacgccatcttcaagctgacgtaccagaacaaggtcgtgaaggtgcagcgccccacccccaccgggaccgtcatggacatcatcagccggaaggaccagcgcggctccggccaggtggggacctacggcctcaacacgttcaccaacatggaggcccagctggtgcggcagatggagggggagggcgtcctgagcaaggcggacctcgagaacccgcacctccccgagaagaagatcacccagtggctggagaccaagggggtggagcgcctcaagcggatggccatctccggcgacgactgcgtggtcaagcccatcgacgaccgcttcgccaacgccctgctggccctcaacgacatgggcaaggtgcggaaggacatcccccagtggcagccgagcaaggggtggcacgactggcagcaggtccccttctgctcccaccacttccacgagctgatcatgaaggacggccgcaagctggtcgtgccctgccggccccaggacgagctcatcgggcgcgcgcgcatcagccagggcgccgggtggtccctgcgggagacggcctgcctgggcaaggcctacgcgcagatgtggagcctcatgtacttccaccgccgggacctgcgcctggcctccaacgccatctgcagcgccgtgccggtccactgggtgcccacctcccggaccacctggagcatccacgcccaccaccagtggatgacgaccgaggacatgctcaccgtgtggaaccgcgtctggatcgaggacaacccctggatggaggacaagacccccgtgacgacctgggagaacgtgccgtacctgggcaagcgggaggaccagtggtgcgggagcctgatcggcctcacctcccgcgcgacctgggcccagaacatccccacggccatccagcaggtccggagcctgatcgggaacgaggagttcctggactacatgccctccatgaagcgcttccggaaggaggaggagctcgagggcgccatctggtga

SEQ ID NO: 9851 - RNA, 9873 nt, synthetic construct
  misc_feature 1..9873: note = derived and/or modified CDS sequence (opt1) from DENV-3__KF041258__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgggacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtggtcatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtctccgccggcagcgggaaggtggacaacttcaccatgggcgtgctgtgcctggcgatcctcttcgaggaggtcatgcgggggaagttcggcaagaagcacatgatcgccggggtgttcttcaccttcgtgctgctgctctccggccagatcacctggcgcgacatggcccacacgctgatcatgatcggcagcaacgcctccgaccggatggggatgggcgtcacctacctggccctcatcgcgaccttcaagatccagcccttcctggccctggggttcttcctccgcaagctgaccagccgggagaacctgctcctgggcgtgggcctggccatggccacgaccctccagctgcccgaggacatcgagcagatggcgaacgggatcgccctgggcctcatggccctgaagctgatgacccagttcgagacctaccagctctggacggccctgatcagcctgacctgctccaacaccatcttcaccctcacggtggcctggcgcaccgcgaccctgatcctggccggggtcagcctcctgccggtgtgccagtccagctccatgcggaagaccgactggctgcccatgacggtcgccgccatgggcgtgccgcccctcccgctgttcatcttcagcctgaaggacaccctcaagcgccgctcctggcccctgaacgagggggtgatggccgtcggcctggtgagcatcctcgcgtccagcctgctgcggaacgacgtgcccatggccggccccctcgtcgccgggggcctgctgatcgcctgctacgtgatcaccgggacctccgccgacctcacggtggagaaggcggccgacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggcggagctggaggagggggtgtaccgcatcaagcagcagggcatcctggggaagacccaggtcggcgtgggggtgcagaaggagggcgtcttccacacgatgtggcacgtgacccggggcgccgtgctcacccacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtccgggaggccatcaagcgccggctccgcaccctgatcctggcccccacccgggtggtggccgccgagatggaggaggcgctcaaggggctgcccatccgctaccagacgaccgccaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtgtggttcgtgcccagcatcaaggccggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggacgaaggagggcgagaagcgcaagctccggccccgctggctggacgcccgcacctactccgacccgctggccctcaaggagttcaaggacttcgcggccggccgcaagagcatcgccctggacctggtgaccgagatcgggcgcgtgccctcccacctcgcccaccggacccgcaacgccctggacaacctggtcatgctccacacgagcgagcacggcgggcgggcgtaccgccacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagaccacgaagcgcgacctgggcatgtccaaggagccgggggtggtgagccccacctcctacctggacgtcgacctccaccccgccagcgcctggaccctgtacgcggtggccaccacggtgatcacccccatgctgcggcacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgacgctgaccgccgccgtgctcctgctgatcacccactacgcgatcatcggccccggcctccaggccaaggccacccgcgaggcccagaagcggacggccgcggggatcatgaagaacccgaccgtcgacggcatcatcaccatcgacctggaccccgtgatctacgactccaagttcgagaagcagctgggccaggtgatgctcctggtcctgtgcgccgtgcagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagaccacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcacggaggtgcgcggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgggtcctgaagatggtggagccgtggctcaagaacaaccagttctgcatcaaggtgctgaacccctacatgcccgcggtcatcgagcacctggagcgcctccagcggaagcacggcgggatgctggtgcgcaaccccctgtcccggaacagcacccacgagatgtactggatctccaacggcaccgggaacatcgtgagctccgtcaacatggtgagccgcctcctgctgaaccggttcacgatgacccaccgccggccgaccatcgagaaggacgtggacctcggcgccggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggccaccgggtccgcgagcagcatgatcaacggcgtcgtgaagctgctgacgaagccctgggacgtcgtgcccatggtgacccagatggccatgaccgacaccacgcccttcgggcagcagcgggtcttcaaggagaaggtggacacccgcaccccgcggcccatgcccggcacccgcaaggtgatggagatcacggccgagtggctctggcggaccctgggccgcaacaagcggccccgcctgtgcacccgcgaggagttcaccaagaaggtccggacgaacgccgcgatgggggccgtgttcaccgaggagaaccagtgggactccgccaaggccgccgtggaggacgaggagttctggaagctcgtcgaccgcgagcgggagctgcacaagctgggcaagtgcgggagctgcgtgtacaacatgatgggcaagcgcgagaagaagctcggggagttcggcaaggcgaagggctcccgggccatctggtacatgtggctgggggcccgctacctggagttcgaggccctcggcttcctgaacgaggaccactggttcagccgggagaactcctacagcggggtggagggcgaggggctgcacaagctcggctacgtcctgcgcgacatctccaagatcccgggcggggccatgtacgcggacgacaccgccggctgggacacccggatcacggaggacgacctgcacaacgaggagaagatcacccagcagatggaccccgagcaccgcctcctggccaacgccatcttcaagctgacctaccagaacaaggtggtgaaggtccagcggcccacccccaccgggacggtgatggacatcatcagccgcaaggaccagcggggctccggccaggtggggacctacggcctcaacaccttcaccaacatggaggcccagctggtccgccagatggagggggagggcgtgctgagcaaggcggacctcgagaacccgcacctccccgagaagaagatcacgcagtggctggagaccaagggggtggagcggctcaagcgcatggccatctccggcgacgactgcgtcgtgaagcccatcgacgaccggttcgccaacgccctgctggccctcaacgacatgggcaaggtgcgcaaggacatcccccagtggcagccgagcaaggggtggcacgactggcagcaggtccccttctgctcccaccacttccacgagctgatcatgaaggacggccggaagctggtggtgccctgccgcccccaggacgagctcatcgggcgggcgcgcatcagccagggcgccgggtggtccctgcgcgagaccgcctgcctgggcaaggcctacgcgcagatgtggagcctcatgtacttccaccggcgcgacctgcggctggcctccaacgccatctgcagcgccgtcccggtgcactgggtgcccacctcccgcacgacctggagcatccacgcccaccaccagtggatgaccaccgaggacatgctcacggtctggaaccgggtgtggatcgaggacaacccctggatggaggacaagacccccgtgaccacctgggagaacgtcccgtacctgggcaagcgcgaggaccagtggtgcgggagcctgatcggcctcacgtcccgggcgacctgggcccagaacatccccaccgccatccagcaggtccgcagcctgatcgggaacgaggagttcctggactacatgccctccatgaagcggttccgcaaggaggaggagctcgagggcgccatctggtga

SEQ ID NO: 9852 - RNA, 9873 nt, synthetic construct
  misc_feature 1..9873: note = derived and/or modified CDS sequence (opt1) from DENV-3__KF041257__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgggacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtggtcatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtctccgccggcagcgggaaggtggacaacttcaccatgggcgtgctgtgcctggcgatcctcttcgaggaggtcatgcgggggaagttcggcaagaagcacatgatcgccggggtgttcttcaccttcgtgctgctgctctccggccagatcacctggcgcgacatggcccacacgctgatcatgatcggcagcaacgcctccgaccggatggggatgggcgtcacctacctggccctcatcgcgaccttcaagatccagcccttcctggccctggggttcttcctccgcaagctgaccagccgggagaacctgctcctgggcgtgggcctggccatggccacgaccctccagctgcccgaggacatcgagcagatggcgaacgggatcgccctgggcctcatggccctgaagctgatcacccagttcgagacctaccagctctggacggccctgatcagcctgacctgctccaacaccatcttcaccctcacggtggcctggcgcaccgcgaccctgatcctggccggggtcagcctcctgccggtgtgccagtccagctccatgcggaagaccgactggctgcccatgacggtcgccgccatgggcgtgccgcccctcccgctgttcatcttcagcctgaaggacaccctcaagcgccgctcctggcccctgaacgagggggtgatggccgtcggcctggtgagcatcctcgcgtccagcctgctgcggaacgacgtgcccatggccggccccctcgtcgccgggggcctgctgatcgcctgctacgtgatcaccgggacctccgccgacctcacggtggagaaggcggccgacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggcggagctggaggagggggtgtaccgcatcaagcagcagggcatcctggggaagacccaggtcggcgtgggggtgcagaaggagggcgtcttccacacgatgtggcacgtgacccggggcgccgtgctcacccacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtccgggaggccatcaagcgccggctccgcaccctgatcctggcccccacccgggtggtggccgccgagatggaggaggcgctcaaggggctgcccatccgctaccagacgaccgccaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtgtggttcgtgcccagcatcaaggccggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggacgaaggagggcgagaagcgcaagctccggccccgctggctggacgcccgcacctactccgacccgctggccctcaaggagttcaaggacttcgcggccggccgcaagagcatcgccctggacctggtgaccgagatcgggcgcgtgccctcccacctcgcccaccggacccgcaacgccctggacaacctggtcatgctccacacgagcgagcacggcgggcgggcgtaccgccacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagaccacgaagcgcgacctgggcatgtccaaggagccgggggtggtgagccccacctcctacctggacgtcgacctccaccccgccagcgcctggaccctgtacgcggtggccaccacggtgatcacccccatgctgcggcacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgacgctgaccgccgccgtgctcctgctgatcacccactacgcgatcatcggccccggcctccaggccaaggccacccgcgaggcccagaagcggacggccgcggggatcatgaagaacccgaccgtcgacggcatcatcaccatcgacctggaccccgtgatctacgactccaagttcgagaagcagctgggccaggtgatgctcctggtcctgtgcgccgtgcagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtcgggaccggcaagcgcggcaccgggagccagggcgagaccctccgggagaagtggaagaagaagctgaaccagctgagccgcaaggagttcgacctctacaagaagtccgggatcacggaggtggaccggaccgaggccaaggagggcctgaagcgcggggagaccacccaccacgccgtgagccggggctccgccaagctgcagtggttcgtcgagcgcaacatggtgatcccggagggccgggtgatcgacctcgggtgcggccgcgggggctggagctactactgcgccgggctgaagaaggtcacggaggtgcgcggctacaccaagggcgggcccggccacgaggagcccgtgcccatgtccacctacgggtggaacatcgtcaagctgatgagcggcaaggacgtgttctacctcccgcccgagaagtgcgacaccctgctgtgcgacatcggggagtccagcccctcccccacggtggaggagagccggaccatccgcgtcctgaagatggtggagccgtggctcaagaacaaccagttctgcatcaaggtgctgaacccctacatgcccgcggtcatcgagcacctggagcggctccagcgcaagcacggcggcatgctggtgcggaaccccctgtcccgcaacagcacccacgagatgtactggatctccaacgggaccggcaacatcgtgagctccgtcaacatggtgagccggctcctgctgaaccgcttcacgatgacccaccggcgcccgaccatcgagaaggacgtggacctcggggccggcacccggcacgtcaacgccgagcccgagacgcccaacatggacgtgatcggcgagcgcatcaagcggatcaaggaggagcacaactccacctggcactacgacgacgagaacccgtacaagacctgggcctaccacgggagctacgaggtgaaggccaccggctccgcgagcagcatgatcaacggggtcgtgaagctgctgacgaagccctgggacgtcgtgcccatggtgacccagatggccatgaccgacaccacgcccttcggccagcagcgcgtcttcaaggagaaggtggacacccggaccccgcgccccatgcccgggacccggaaggtgatggagatcacggccgagtggctctggcgcaccctgggccggaacaagcgcccccgcctgtgcacccgggaggagttcaccaagaaggtccgcacgaacgccgcgatgggcgccgtgttcaccgaggagaaccagtgggactccgccaaggccgccgtggaggacgaggagttctggaagctcgtcgaccgggagcgcgagctgcacaagctggggaagtgcggcagctgcgtgtacaacatgatggggaagcgggagaagaagctcggcgagttcgggaaggcgaagggctcccgcgccatctggtacatgtggctgggcgcccggtacctggagttcgaggccctcgggttcctgaacgaggaccactggttcagccgcgagaactcctacagcggcgtggagggggagggcctgcacaagctcgggtacatcctgcgggacatctccaagatcccgggcggcgccatgtacgcggacgacaccgccgggtgggacacccgcatcacggaggacgacctgcacaacgaggagaagatcacccagcagatggaccccgagcaccggctcctggccaacgccatcttcaagctgacctaccagaacaaggtcgtgaaggtgcagcgccccacccccaccggcacggtcatggacatcatcagccggaaggaccagcgcgggtccggccaggtgggcacctacgggctcaacaccttcaccaacatggaggcccagctggtgcggcagatggagggcgagggggtcctgagcaaggcggacctcgagaacccgcacctccccgagaagaagatcacgcagtggctggagaccaagggcgtggagcgcctcaagcggatggccatctccggggacgactgcgtggtcaagcccatcgacgaccgcttcgccaacgccctgctggccctcaacgacatgggcaaggtgcggaaggacatcccccagtggcagccgagcaagggctggcacgactggcagcaggtccccttctgctcccaccacttccacgagctgatcatgaaggacgggcgcaagctggtcgtgccctgccggccccaggacgagctcatcggccgcgcgcgcatcagccagggggccggctggtccctgcgggagaccgcctgcctggggaaggcctacgcgcagatgtggagcctcatgtacttccaccgccgggacctgcgcctggcctccaacgccatctgcagcgccgtgccggtccactgggtgcccacctcccggacgacctggagcatccacgcccaccaccagtggatgaccaccgaggacatgctcacggtgtggaaccgcgtctggatcgaggacaacccctggatggaggacaagacccccgtgaccacctgggagaacgtgccgtacctgggcaagcgggaggaccagtggtgcggcagcctgatcgggctcacgtcccgcgcgacctgggcccagaacatccccaccgccatccagcaggtccggagcctgatcggcaacgaggagttcctggactacatgccctccatgaagcgcttccggaaggaggaggagctcgagggggccatctggtga

SEQ ID NO: 9853 - RNA, 9873 nt, synthetic construct
  misc_feature 1..9873: note = derived and/or modified CDS sequence (opt1) from DENV-3__KF041255__SS-prME
  source 1..9873: mol_type = other RNA
accagcctgtgcctcatgatgatcctgcccgccgccctggcgttccacctcaccagccggaacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgggacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtggtcatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtctccgccggcagcgggaaggtggacaacttcaccatgggcgtgctgtgcctggcgatcctcttcgaggaggtcatgcgggggaagttcggcaagaagcacatgatcgccggggtgttcttcaccttcgtgctgctgctctccggccagatcacctggcgcgacatggcccacacgctgatcatgatcggcagcaacgcctccgaccggatggggatgggcgtcacctacctggccctcatcgcgaccttcaagatccagcccttcctggccctggggttcttcctccgcaagctgaccagccgggagaacctgctcctgggcgtgggcctggccatggccacgaccctccagctgcccgaggacatcgagcagatggcgaacgggatcgccctgggcctcatggccctgaagctgatcacccagttcgagacctaccagctctggacggccctgatcagcctgacctgctccaacaccatcttcaccctcacggtggcctggcgcaccgcgaccctgatcctggccggggtcagcctcctgccggtgtgccagtccagctccatgcggaagaccgactggctgcccatgacggtcgccgccatgggcgtgccgcccctcccgctgttcatcttcagcctgaaggacaccctcaagcgccgctcctggcccctgaacgagggggtgatggccgtcggcctggtgagcatcctcgcgtccagcctgctgcggaacgacgtgcccatggccggccccctcgtcgccgggggcctgctgatcgcctgctacgtgatcaccgggacctccgccgacctcacggtggagaaggcggccgacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggcggagctggaggagggggtgtaccgcatcaagcagcagggcatcctggggaagacccaggtcggcgtgggggtgcagaaggagggcgtcttccacacgatgtggcacgtgacccggggcgccgtgctcacccacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtccgggaggccatcaagcgccggctccgcaccctgatcctggcccccacccgggtggtggccgccgagatggaggaggcgctcaaggggctgcccatccgctaccagacgaccgccaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtgtggttcgtgcccagcatcaaggccggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggacgaaggagggcgagaagcgcaagctccggccccgctggctggacgcccgcacctactccgacccgctggccctcaaggagttcaaggacttcgcggccggccgcaagagcatcgccctggacctggtgaccgagatcgggcgcgtgccctcccacctcgcccaccggacccgcaacgccctggacaacctggtcatgctccacacgagcgagcacggcgggcgggcgtaccgccacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagaccacgaagcgcgacctgggcatgtccaaggagccgggggtggtgagccccacctcctacctggacgtcgacctccaccccgccagcgcctggaccctgtacgcggtggccaccacggtgatcacccccatgctgcggcacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgacgctgaccgccgccgtgctcctgctgatcacccactacgcgatcatcggccccggcctccaggccaaggccacccgcgaggcccagaagcggacggccgcggggatcatgaagaacccgaccgtcgacggcatcatcaccatcgacctggaccccgtgatctacgactccaagttcgagaagcagctgggccaggtgatgctcctggtcctgtgcgccgtgcagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagaccacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcacggaggtgcgcggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgggtcctgaagatggtggagccgtggctcaagaacaaccagttctgcatcaaggtgctgaacccctacatgcccgcggtcatcgagcacctggagcgcctccagcggaagcacggcgggatgctggtgcgcaaccccctgtcccggaacagcacccacgagatgtactggatctccaacggcaccgggaacatcgtgagctccgtcaacatggtgagccgcctcctgctgaaccggttcaagatgacgcaccgccggccgaccatcgagaaggacgtggacctcggcgccggcacccgccacgtcaacgccgagcccgagacccccaacatggacgtgatcggggagcggatcaagcgcatcaaggaggagcacaactccacgtggcactacgacgacgagaacccgtacaagacctgggcctaccacggcagctacgaggtgaaggccaccgggtccgcgagcagcatgatcaacggcgtcgtgaagctgctgaccaagccctgggacgtcgtgcccatggtgacgcagatggccatgaccgacaccacccccttcgggcagcagcgggtcttcaaggagaaggtggacacgcgcaccccgcggcccatgcccggcacccgcaaggtgatggagatcaccgccgagtggctctggcggacgctgggccgcaacaagcggccccgcctgtgcacccgcgaggagttcaccaagaaggtccggaccaacgccgcgatgggggccgtgttcacggaggagaaccagtgggactccgccaaggccgccgtggaggacgaggagttctggaagctcgtcgaccgcgagcgggagctgcacaagctgggcaagtgcgggagctgcgtgtacaacatgatgggcaagcgcgagaagaagctcggggagttcggcaaggcgaagggctcccgggccatctggtacatgtggctgggggcccgctacctggagttcgaggccctcggcttcctgaacgaggaccactggttcagccgggagaactcctacagcggggtggagggcgaggggctgcacaagctcggctacatcctgcgcgacatctccaagatcccgggcggggccatgtacgcggacgacaccgccggctgggacacccggatcaccgaggacgacctgcacaacgaggagaagatcacgcagcagatggaccccgagcaccgcctcctggccaacgccatcttcaagctgacctaccagaacaaggtcgtgaaggtgcagcggcccacccccaccgggaccgtcatggacatcatcagccgcaaggaccagcggggctccggccaggtggggacgtacggcctcaacaccttcaccaacatggaggcccagctggtgcgccagatggagggggagggcgtcctgagcaaggcggacctcgagaacccgcacctccccgagaagaagatcacccagtggctggagacgaagggggtggagcggctcaagcgcatggccatctccggcgacgactgcgtggtcaagcccatcgacgaccggttcgccaacgccctgctggccctcaacgacatgggcaaggtgcgcaaggacatcccccagtggcagccgagcaaggggtggcacgactggcagcaggtccccttctgctcccaccacttccacgagctgatcatgaaggacggccggaagctggtcgtgccctgccgcccccaggacgagctcatcgggcgggcgcgcatcagccagggcgccgggtggtccctgcgcgagaccgcctgcctgggcaaggcctacgcgcagatgtggagcctcatgtacttccaccggcgcgacctgcggctggcctccaacgccatctgcagcgccgtgccggtccactgggtgcccacctcccgcaccacgtggagcatccacgcccaccaccagtggatgaccaccgaggacatgctcaccgtgtggaaccgggtctggatcgaggacaacccctggatggaggacaagacgcccgtgaccacctgggagaacgtgccgtacctgggcaagcgcgaggaccagtggtgcgggagcctgatcggcctcacctcccgggcgacgtgggcccagaacatccccaccgccatccagcaggtccgcagcctgatcgggaacgaggagttcctggactacatgccctccatgaagcggttccgcaaggaggaggagctcgagggcgccatctggtga

SEQ ID NO: 9854 - RNA, 9873 nt, synthetic construct
  misc_feature 1..9873: note = derived and/or modified CDS sequence (opt1) from DENV-3__KF041256__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgggacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtggtcatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtctccgccggcagcgggaaggtggacaacttcaccatgggcgtgctgtgcctggcgatcctcttcgaggaggtcatgcgggggaagttcggcaagaagcacatgatcgccggggtgttcttcaccttcgtgctgctgctctccggccagatcacctggcgcgacatggcccacacgctgatcatgatcggcagcaacgcctccgaccggatggggatgggcgtcacctacctggccctcatcgcgaccttcaagatccagcccttcctggccctggggttcttcctccgcaagctgaccagccgggagaacctgctcctgggcgtgggcctggccatggccacgaccctccagctgcccgaggacatcgagcagatggcgaacgggatcgccctgggcctcatggccctgaagctgatcacccagttcgagacctaccagctctggacggccctgatcagcctgacctgctccaacaccatcttcaccctcacggtggcctggcgcaccgcgaccctgatcctggccggggtcagcctcctgccggtgtgccagtccagctccatgcggaagaccgactggctgcccatgacggtcgccgccatgggcgtgccgcccctgccgctgttcatcttcagcctgaaggacaccctcaagcgccgctcctggcccctgaacgagggggtgatggccgtcggcctggtgagcatcctcgcgtccagcctgctgcggaacgacgtgcccatggccggccccctcgtcgccgggggcctgctgatcgcctgctacgtgatcaccgggacctccgccgacctcacggtggagaaggcggccgacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggcggagctggaggagggggtgtaccgcatcaagcagcagggcatcctggggaagacccaggtcggcgtgggggtgcagaaggagggcgtcttccacacgatgtggcacgtgacccggggcgccgtgctcacccacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtccgggaggccatcaagcgccggctccgcaccctgatcctggcccccacccgggtggtggccgccgagatggaggaggcgctcaaggggctgcccatccgctaccagacgaccgccaccaagtccgagcacaccggccgggagatcgtcgacctgatgtgccacgccacgctcaccatgcgcctgctgagccccgtgcgggtgccgaactacaacctcatcatcatggacgaggcccacttcaccgaccccgcctccatcgcggcccgcgggtacatcagcacccgggtcggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtgtggttcgtgcccagcatcaaggccggcaacgacatcgccaactgcctgcggaagaacgggaagaaggtcatccagctgtcccgcaagaccttcgacaccgagtaccagaagaccaagctcaacgactgggacttcgtggtgacgaccgacatcagcgagatgggcgccaacttcaaggccgaccgggtcatcgacccgcgccggtgcctgaagcccgtgatcctgaccgacggccccgagcgcgtgatcctcgcggggcccatgccggtcaccgccgcctccgccgcccagcggcgcggccgggtggggcgcaacccccagaaggagaacgaccagtacatcttcaccggccagcccctgaacaacgacgaggaccacgcgcactggacggaggccaagatgctgctcgacaacatcaacacccccgaggggatcatcccggccctgttcgagcccgagcgggagaagtccgccgcgatcgacggcgagtaccgcctgaagggcgagtcccggaagaccttcgtggagctcatgcgccgcggggacctgcccgtctggctggcccacaaggtggccagcgagggcatcaagtacaccgaccgcaagtggtgcttcgacgggcagcggaacaaccagatcctcgaggagaacatggacgtcgagatctggacgaaggagggcgagaagcgcaagctgcggccccgctggctggacgcccgcacctactccgacccgctcgccctgaaggagttcaaggacttcgcggccggccgcaagagcatcgccctggacctcgtgaccgagatcgggcgcgtgccctcccacctggcccaccggacccgcaacgccctggacaacctcgtcatgctgcacacgagcgagcacggcgggcgggcgtaccgccacgccgtggaggagctgcccgagaccatggagaccctcctgctgctcggcctgatgatcctgctcaccgggggcgccatgctgttcctgatcagcggcaaggggatcggcaagacgtccatcgggctcatctgcgtgatcgccagctccggcatgctgtggatggccgagatcccgctgcagtggatcgcgagcgccatcgtcctcgagttcttcatgatggtgctgctgatccccgagcccgagaagcagcggacgccccaggacaaccagctcgcctacgtggtcatcgggatcctgaccctggccgccatcatcgcggccaacgagatgggcctcctggagaccacgaagcgcgacctgggcatgtccaaggagccgggggtggtgagccccacctcctacctcgacgtcgacctgcaccccgccagcgcctggaccctgtacgcggtggccaccacggtgatcacccccatgctccggcacaccatcgagaactccaccgccaacgtcagcctggccgccatcgcgaaccaggccgtggtgctgatgggcctcgacaaggggtggccgatctccaagatggacctgggcgtccccctgctcgccctggggtgctacagccaggtgaaccccctgacgctcaccgccgccgtgctgctgctcatcacccactacgcgatcatcggccccggcctgcaggccaaggccacccgcgaggcccagaagcggacggccgcggggatcatgaagaacccgaccgtcgacggcatcatcaccatcgacctggaccccgtgatctacgactccaagttcgagaagcagctcggccaggtgatgctgctggtcctctgcgccgtgcagctgctgctcatgcgcaccagctgggccctgtgcgaggccctgacgctcgcgaccggccccatcaccaccctgtgggagggctcccccgggaagttctggaacacgaccatcgccgtgagcatggccaacatcttccggggctcctacctggccggggccggcctcgcgttcagcatcatgaagtccgtcgggaccggcaagcgcggcaccgggagccagggcgagaccctgggggagaagtggaagaagaagctgaaccagctcagccggaaggagttcgacctgtacaagaagtccggcatcacggaggtggaccgcaccgaggccaaggaggggctgaagcggggcgagaccacccaccacgccgtgagccgcggctccgccaagctccagtggttcgtcgagcggaacatggtgatcccggaggggcgcgtgatcgacctgggctgcgggcggggcgggtggagctactactgcgccggcctgaagaaggtcacggaggtgcgcggctacaccaagggcgggcccgggcacgagaagcccgtgcccatgtccacctacggctggaacatcgtcaagctcatgagcgggaaggacgtgttctacctgccgcccgagaagtgcgacaccctgctgtgcgacatcggcgagtccagcccctcccccacggtggaggagagccgcaccatccgggtcctcaagatggtggagccgtggctgaagaacaaccagttctgcatcaaggtgctgaacccctacatgcccgcggtcatcgagcacctcgagcgcctgcagcggaagcacggcgggatgctggtgcgcaaccccctctcccggaacagcacccacgagatgtactggatctccaacggcaccgggaacatcgtgagctccgtcaacatggtgagccgcctgctgctcaaccggttcaagatgacgcaccgccggccgaccatcgagaaggacgtggacctgggcgccggcacccgccacgtcaacgccgagcccgagacccccaacatggacgtgatcggggagcggatcaagcgcatcaaggaggagcacaactccacgtggcactacgacgacgagaacccgtacaagacctgggcctaccacggcagctacgaggtgaaggccaccgggtccgcgagcagcatgatcaacggcgtcgtgaagctgctcaccaagccctgggacgtcgtgcccatggtgacgcagatggccatgaccgacaccacccccttcgggcagcagcgggtcttcaaggagaaggtggacacgcgcaccccgcggcccatgcccggcacccgcaaggtgatggagatcaccgccgagtggctgtggcggacgctgggccgcaacaagcggccccgcctctgcacccgcgaggagttcaccaagaaggtccggaccaacgccgcgatgggggccgtgttcacggaggagaaccagtgggactccgccaaggccgccgtggaggacgaggagttctggaagctggtcgaccgcgagcgggagctgcacaagctcggcaagtgcgggagctgcgtgtacaacatgatgggcaagcgcgagaagaagctgggggagttcggcaaggcgaagggctcccgggccatctggtacatgtggctgggggcccgctacctcgagttcgaggccctgggcttcctgaacgaggaccactggttcagccgggagaactcctacagcggggtggagggcgaggggctccacaagctgggctacatcctgcgcgacatctccaagatcccgggcggggccatgtacgcggacgacaccgccggctgggacacccggatcaccgaggacgacctccacaacgaggagaagatcacgcagcagatggaccccgagcaccgcctgctggccaacgccatcttcaagctcacctaccagaacaaggtcgtgaaggtgcagcggcccacccccaccgggaccgtcatggacatcatcagccgcaaggaccagcggggctccggccaggtggggacgtacggcctgaacaccttcaccaacatggaggcccagctggtgcgccagatggagggggagggcgtcctcagcaaggcggacctggagaacccgcacctccccgagaagaagatcacccagtggctcgagacgaagggggtggagcggctgaagcgcatggccatctccggcgacgactgcgtggtcaagcccatcgacgaccggttcgccaacgccctgctcgccctgaacgacatgggcaaggtgcgcaaggacatcccccagtggcagccgagcaaggggtggcacgactggcagcaggtccccttctgctcccaccacttccacgagctgatcatgaaggacggccggaagctcgtcgtgccctgccgcccccaggacgagctgatcgggcgggcgcgcatcagccagggcgccgggtggtccctgcgcgagaccgcctgcctcggcaaggcctacgcgcagatgtggagcctgatgtacttccaccggcgcgacctgcggctcgcctccaacgccatctgcagcgccgtgccgatccactgggtccccacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccgtacctgggcaagcgcgaggaccagtggtgcgggagcctcatcggcctgacctcccgggcgacgtgggcccagaacatccccaccgccatccagcaggtccgcagcctgatcgggaacgaggagttcctcgactacatgccctccatgaagcggttccgcaaggaggaggagctggagggcgccatctggtga

SEQ ID NO: 9855 - RNA, 9873 nt, synthetic construct
  misc_feature 1..9873: note = derived and/or modified CDS sequence (opt1) from DENV-3__KF041254__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgtggtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggcggacctgggggaaggccaagatcgtcaccgccgagacgcagaacagctccttcatcatcgacggccccaacacccccgagtgccccagcgcctcccgcgcgtggaacgtgtgggaggtggaggactacgggttcggcgtcttcaccaccaacatctggctcaagctgcgggagatgtacacccagatgtgcgaccaccgcctgatgagcgccgccgtgaaggacgagcgggccgtgcacgccgacatgggctactggatcgagagccagaagaacgggtcctggaagctcgagaaggcgagcctgatcgaggtcaagacgtgcacctggccgaagtcccacaccctgtggagcaacggcgtgctcgagtccgacatgatcatccccaagagcctggccgggcccatctcccagcacaactaccgcccgggctaccacacccagacggccgggccctggcacctgggcaagctcgagctggacttcaactactgcgagggcaccaccgtggtcatcaccgagaactgcgggacgcggggccccagcctgcgcaccaccaccgtgtccgggaagctcatccacgagtggtgctgccggagctgcacgctgcccccgctgcgctacatgggcgaggacgggtgctggtacggcatggagatccggcccatctccgagaaggaggagaacatggtcaagagcctcgtctccgccggcagcgggaaggtggacaacttcaccatgggcgtgctgtgcctggccatcctcttcgaggaggtcatgcgcgggaagttcggcaagaagcacatgatcgcgggggtgttcttcaccttcgtgctgctgctctccggccagatcacctggcgggacatggcccacacgctgatcatgatcggcagcaacgcctccgaccgcatggggatgggcgtcacctacctggccctcatcgccaccttcaagatccagcccttcctggcgctggggttcttcctccggaagctgaccagccgcgagaacctgctcctgggcgtgggcctggccatggccacgaccctccagctgcccgaggacatcgagcagatggccaacgggatcgcgctgggcctcatggccctgaagctgatcacccagttcgagacctaccagctctggacggccctgatcagcctgacctgctccaacaccatcttcaccctcacggtggcctggcggaccgccaccctgatcctggcgggggtcagcctcctgccggtgtgccagtccagctccatgcgcaagaccgactggctgcccatgacggtcgccgccatgggcgtgccgcccctgccgctgttcatcttcagcctgaaggacaccctcaagcgccggtcctggcccctgaacgagggggtgatggccgtcggcctggtgagcatcctcgcctccagcctgctgcgcaacgacgtgcccatggcgggccccctcgtcgccgggggcctgctgatcgcctgctacgtgatcaccgggacctccgccgacctcacggtggagaaggccgcggacgtcacctgggaggaggaggccgagcagaccggcgtgagccacaacctgatgatcaccgtggacgacgacgggaccatgcggatcaaggacgacgagacggagaacatcctgaccgtcctcctgaagaccgccctgctcatcgtgtccggcatcttcccgtacagcatccccgccaccctgctggtgtggcacacgtggcagaagcagacccagcgctccggcgtcctctgggacgtgcccagcccgcccgagacccagaaggccgagctggaggagggggtgtaccggatcaagcagcagggcatcctggggaagacccaggtcggcgtgggggtgcagaaggagggcgtcttccacacgatgtggcacgtgacccgcggcgcggtgctcacccacaacgggaagcggctggagcccaactgggcctccgtcaagaaggacctgatcagctacggcgggggctggcgcctctccgcccagtggcagaagggggaggaggtccaggtgatcgccgtcgagcccggcaagaaccccaagaacttccagaccatgcccggcacgttccagaccaccaccggggagatcggcgcgatcgccctggacttcaagcccgggacgagcggcagccccatcatcaaccgggagggcaaggtggtggggctgtacggcaacggggtcgtgaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggccatcgtccgcgaggcgatcaagcggcgcctccggaccctgatcctggcccccacccgcgtggtggccgccgagatggaggaggccctcaaggggctgcccatccggtaccagacgaccgcgaccaagtccgagcacaccggccgcgagatcgtcgacctgatgtgccacgccacgttcaccatgcggctcctgagccccgtgcgcgtgccgaactacaacctgatcatcatggacgaggcccacttcaccgaccccgcctccatcgccgcgcgggggtacatcagcacccgcgtcggcatgggcgaggccgccgccatcttcatgacggcgacgccgcccgggaccgccgacgccttcccgcagtccaacgcccccatccaggacgaggagcgcgacatccccgagcggagctggaactccggcaacgagtggatcaccgacttcgccgggaagacggtgtggttcgtgcccagcatcaaggcgggcaacgacatcgccaactgcctccgcaagaacgggaagaaggtcatccagctgtcccggaagaccttcgacaccgagtaccagaagaccaagctgaacgactgggacttcgtggtgacgaccgacatcagcgagatgggcgccaacttcaaggccgaccgcgtcatcgacccgcggcgctgcctcaagcccgtgatcctgaccgacggccccgagcgggtgatcctggccgggcccatgccggtcaccgcggcctccgccgcccagcgccggggccgcgtggggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtcgagatctggacgaaggagggcgagaagcggaagctccgcccccgctggctggacgcccggacctactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgcccgagaccatggagaccctgctcctgctgggcctcatgatcctgctgaccgggggcgccaccctcttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagacgaccaagcgggacctgggcatgtccaaggagccgggggtggtgagccccacctcctacctggacgtcgacctccaccccgccagcgcctggaccctgtacgccgtggcgacgaccgtgatcacccccatgctgcgccacaccatcgagaactccacggccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgaccgccgccgtgctcctgctgatcacccactacgccatcatcggccccggcctccaggcgaaggccacgcgggaggcccagaagcgcaccgccgccgggatcatgaagaacccgaccgtcgacggcatcatcaccatcgacctggaccccgtgatctacgactccaagttcgagaagcagctgggccaggtgatgctcctggtcctgtgcgcggtgcagctcctgctgatgcggacgagctgggccctctgcgaggccctgaccctggccaccggccccatcaccacgctctgggagggctcccccgggaagttctggaacaccaccatcgcggtgagcatggccaacatcttccgcggctcctacctggcccgggccgggctggccttcagcatcatgaagtccgtcggcaccgggaagcgcggcaccggcagccagggggagacgctcggcgagaagtggaagaagaagctgaaccagctgagccggaaggagttcgacctctacaagaagtccgggatcaccgaggtggaccgcaccgaggcgaaggagggcctgaagcgcggggagaccacgcaccacgccgtgagccgcggctccgccaagctgcagtggttcgtcgagcggaacatggtgatcccggagggccgcgtgatcgacctcgggtgcggccgcgggggctggagctactactgcgccgggctgaagaaggtcaccgaggtgcggggctacaccaagggcgggcccggccacgaggagcccgtgcccatgtccacctacgggtggaacatcgtcaagctgatgagcggcaaggacgtgttctacctcccgcccgagaagtgcgacacgctgctgtgcgacatcggggagtccagcccctcccccaccgtggaggagagccgcaccatccgggtcctgaagatggtggagccgtggctcaagaacaaccagttctgcatcaaggtgctgaacccctacatgcccgccgtcatcgagcacctggagcgcctccagcggaagcacggcggcatgctggtgcgcaaccccctgtcccggaacagcacccacgagatgtactggatctccaacgggacgggcaacatcgtgagctccgtcaacatggtgagcaagctcctgctgaaccgcttcaccatgacccaccggcgcccgaccatcgagaaggacgtggacctcggggcgggcacgcggcacgtcaacgccgagcccgagacccccaacatggacgtgatcggcgagcgcatcaagcggatcaaggaggagcacaactccacctggcactacgacgacgagaacccgtacaagacctgggcctaccacgggagctacgaggtgaaggccacgggctccgccagcagcatgatcaacggggtcgtgaagctgctgaccaagccctgggacgtcgtgcccatggtgacccagatggcgatgaccgacacgacccccttcggccagcagcgcgtcttcaaggagaaggtggacacccggaccccgcgccccatgcccgggacgcggaaggtgatggagatcaccgccgagtggctctggcgcaccctgggccggaacaagcgcccccgcctgtgcacccgggaggagttcacgaagaaggtccgcaccaacgccgccatgggcgcggtgttcaccgaggagaaccagtgggactccgccaaggccgccgtggaggacgaggagttctggaagctcgtcgaccgggagcgcgagctgcacaagctggggaagtgcggcagctgcgtgtacaacatgatggggaagcgggagaagaagctcggcgagttcgggaaggccaagggctcccgcgcgatctggtacatgtggctgggcgcccggtacctggagttcgaggccctcgggttcctgaacgaggaccactggttcagccgcgagaactcctacagcggcgtggagggggagggcctgcacaagctcgggtacatcctgcgggacatctccaagatcccgggcggcgccatgtacgccgacgacaccgcggggtgggacacgcgcatcaccgaggacgacctgcacaacgaggagaagatcacccagcagatggaccccgagcaccggctcctggccaacgccatcttcaagctgacctaccagaacaaggtcgtgaaggtgcagcgccccacccccacgggcaccgtcatggacatcatcagccggaaggaccagcgcgggtccggccaggtgggcacctacgggctcaacaccttcacgaacatggaggcccagctggtgcggcagatggagggcgagggggtcctgagcaaggccgacctcgagaacccgcacctccccgagaagaagatcacccagtggctggagaccaagggcgtggagcgcctcaagcggatggcgatctccggggacgactgcgtggtcaagcccatcgacgaccgcttcgccaacgccctgctggccctcaacgacatgggcaaggtgcggaaggacatcccccagtggcagccgagcaagggctggcacgactggcagcaggtccccttctgctcccaccacttccacgagctgatcatgaaggacgggcgcaagctggtcgtgccctgccggccccaggacgagctcatcggccgcgcccgcatcagccagggggcgggctggtccctgcgggagaccgcctgcctggggaaggcctacgcccagatgtggagcctcatgtacttccaccgccgggacctgcgcctggcgtccaacgccatctgcagcgccgtgccggtccactgggtgcccacgtcccggaccacctggagcatccacgcccaccaccagtggatgaccacggaggacatgctcaccgtgtggaaccgcgtctggatcgaggacaacccctggatggaggacaagacccccgtgaccacgtgggagaacgtgccgtacctgggcaagcgggaggaccagtggtgcggcagcctgatcgggctcacctcccgcgccacctgggcgcagaacatccccaccgccatccagcaggtccggagcctgatcggcaacgaggagttcctggactacatgccctccatgaagcgcttccggaaggaggaggagctcgagggggccatctggtga

SEQ ID NO: 9856 - RNA, 9873 nt, synthetic construct
  misc_feature 1..9873: note = derived and/or modified CDS sequence (opt1) from DENV-3__KX380841__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccaggggatcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgcgccgtgcaagatccccttcagcaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacaccatcggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtgtgggaggtcgaggactacgggttcggcgtgttcaccaccaacatctggctcaagctgcgcgaggtgtacacccagatgtgcgaccaccggctgatgagcgccgccgtcaaggacgagcgcgccgtgcacgcggacatgggctactggatcgagagccagaagaacgggtcctggaagctcgagaaggccagcctgatcgaggtgaagacgtgcacctggccgaagtcccacaccctgtggagcaacggcgtcctcgagtccgacatgatcatccccaagagcctggccgggcccatctcccagcacaactaccggccgggctaccacacccagacggccgggccctggcacctgggcaagctcgagctggacttcaactactgcgagggcaccaccgtggtgatcaccgagaactgcgggacgcgcggccccagcctgcggaccaccaccgtctccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtgtccgccggcagcgggaaggtcgacaacttcaccatgggcgtgctgtgcctggcgatcctcttcgaggaggtgatgcgggggaagttcggcaagaagcacatgatcgccggggtcttcttcaccttcgtgctgctgctctccggccagatcacctggcgcgacatggcccacacgctgatcatgatcggcagcaacgcctccgaccggatggggatgggcgtgacctacctggccctcatcgcgaccttcaagatccagcccttcctggccctggggttcttcctccgcaagctgaccagccgggagaacctgctcctgggcgtcggcctggccatggccacgaccctccagctgcccgaggacatcgagcagatggcgaacgggatcgccctgggcctcatggccctgaagctgatcacccagttcgagacctaccagctctggacggccctgatcagcctgacctgctccaacaccatcttcaccctcacggtggcctggcgcaccgcgaccctgatcctggccggggtgagcctcctgccggtctgccagtccagctccatgcggaagaccgactggctgcccatgacggtggccgccatgggcgtgccgcccctcccgctgttcatcttcagcctgaaggacaccctcaagcgccgctcctggcccctgaacgagggggtgatggccgtgggcctggtcagcatcctcgcgtccagcctgctgcggaacgacgtgcccatggccggccccctcgtggccgggggcctgctgatcgcctgctacgtcatcaccgggacctccgccgacctcacggtggagaaggcggccgacgtgacctgggaggaggaggccgagcagaccggcgtcagccacaacctgatgatcaccgtggacgacgacgggaccatgcgcatcaaggacgacgagacggagaacatcctgaccgtgctcctgaagaccgccctgctcatcgtctccggcatcttcccgtacagcatccccgccaccctgctggtgtggcacacgtggcagaagcagacccagcggtccggcgtgctctgggacgtccccagcccgcccgagacccagaaggcggagctggaggagggggtgtaccgcatcaagcagcagggcatcctggggaagacccaggtgggcgtcggggtgcagaaggacggcgtgttccacacgatgtggcacgtcacccggggcgccgtgctcacccacaacgggaagcgcctggagcccaactgggcctccgtgaagaaggacctgatcagctacggcgggggctggcggctctccgcccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgcgagggcaaggtcgtggggctgtacggcaacggggtggtcaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtgcgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgcggcccgcgggtacatcagcacccgggtgggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtctggttcgtgcccagcatcaaggccggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgcggccggccgcaagagcatcgccctggacctggtcaccgagatcgggcgggtgccctcccacctcgcccaccgcacccggaacgccctggacaacctggtgatgctccacacgagcgagcacggcgggcgcgcgtaccggcacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccatggccgccatcatcgcggccaacgagatgggcctgctggagaccacgaagcgggacctcggcatgtccaaggagccgggggtcgtgagccccacctcctacctggacgtggacctgcaccccgccagcgcctggaccctctacgcggtcgccaccacggtgatcacccccatgctgcgccacaccatcgagaactccaccgccaacgtgagcctggccgccatcgcgaaccaggccgtcgtgctcatgggcctggacaaggggtggccgatctccaagatggacctgggcgtgcccctcctggccctggggtgctacagccaggtcaaccccctcacgctgaccgccgccgtgctgctcctggtgacccactacgcgatcatcggccccggcctgcaggccaaggccacccgggaggcccagaagcgcacggccgcggggatcatgaagaacccgaccgtcgacggcatcatcaccatcgacctcgaccccgtgatctacgactccaagttcgagaagcagctgggccaggtgatgctgctcgtcctgtgcgccgtgcagctgctcctgatgcggaccagctgggccctgtgcgaggccctcacgctggcgaccggccccatcaccaccctgtgggagggctcccccgggaagttctggaacacgaccatcgccgtgagcatggccaacatcttccgcggctcctacctcgccggggccggcctggcgttcagcatcatgaagtccgtcgggaccggcaagcggggcaccgggagccagggcgagaccctgggggagaagtggaagaagaagctcaaccagctgagccgcaaggagttcgacctgtacaagaagtccggcatcacggaggtggaccggaccgaggccaaggaggggctcaagcgcggcgagaccacccaccacgccgtgagccggggctccgccaagctgcagtggttcgtcgagcgcaacatggtgatcccggaggggcgggtgatcgacctgggctgcgggcgcggcgggtggagctactactgcgccggcctcaagaaggtcacggaggtgcggggctacaccaagggcgggcccgggcacgaggagcccgtgcccatgtccacctacggctggaacatcgtcaagctgatgagcgggaaggacgtgttctacctgccgcccgagaagtgcgacaccctcctgtgcgacatcggcgagtccagcccctcccccacggtggaggagagccgcaccatccgcgtcctgaagatggtggagccgtggctgaagaacaaccagttctgcatcaaggtgctcaacccctacatgcccgcggtcatcgagcacctggagcggctgcagcgcaagcacggcgggatgctcgtgcggaaccccctgtcccgcaacagcacccacgagatgtactggatctccaacggcaccgggaacatcgtgagctccgtcaacatggtgagccggctgctcctgaaccgcttcacgatgacccaccggcgcccgaccatcgagaaggacgtggacctgggcgccggcacccggcacgtcaacgccgagcccgagacgcccaacatggacgtgatcggggagcgcatcaagcggatcaaggaggagcacaactccacctggcactacgacgacgagaacccgtacaagacctgggcctaccacggcagctacgaggtgaaggccaccgggtccgcgagcagcatgatcaacggcgtcgtgaagctcctgacgaagccctgggacgtcgtgcccatggtgacccagatggccatgaccgacaccacgcccttcgggcagcagcgcgtcttcaaggagaaggtggacacccggaccccgcgccccatgcccggcacccggaaggtgatggagatcacggccgagtggctgtggcgcaccctcggccggaacaagcgcccccggctgtgcacccgcgaggagttcaccaagaaggtccgcacgaacgccgcgatgggggccgtgttcaccgaggagaaccagtgggactccgccaaggccgccgtggaggacgaggagttctggaagctggtcgaccgggagcgcgagctccacaagctgggcaagtgcgggagctgcgtgtacaacatgatgggcaagcgggagaagaagctgggggagttcggcaaggcgaagggctcccgcgccatctggtacatgtggctcggggcccggtacctggagttcgaggccctgggcttcctcaacgaggaccactggttcagccgcgagaactcctacagcggggtggagggcgaggggctgcacaagctgggctacatcctccgggacatctccaagatcccgggcggggccatgtacgcggacgacaccgccggctgggacacccgcatcacggaggacgacctgcacaacgaggagaagatcacccagcagatggaccccgagcaccggctgctcgccaacgccatcttcaagctgacctaccagaacaaggtcgtgaaggtgcagcgccccacccccaccgggacggtcatggacatcatcagccggaaggaccagcgcggctccggccaggtggggacctacggcctgaacaccttcaccaacatggaggcccagctcgtgcggcagatggagggggagggcgtcctgagcaagacggacctggagaacccgcacctccccgagaagaagatcacccagtggctggagaccaagggggtggagcgcctgaagcggatggcgatctccggcgacgactgcgtggtcaagcccatcgacgaccgcttcgccaacgccctcctggccctgaacgacatgggcaaggtgcggaaggacatcccccagtggcagccgagcaaggggtggcacgactggcagcaggtccccttctgctcccaccacttccacgagctcatcatgaaggacggccgcaagctggtcgtgccctgccggccccaggacgagctgatcgggcgcgcccggatcagccagggcgcggggtggtccctccgcgagaccgcctgcctgggcaaggcctacgcccagatgtggagcctgatgtacttccaccgccgggacctccgcctggcgtccaacgccatctgcagcgccgtgccggtccactgggtgcccacgtcccggaccacctggagcatccacgcccaccaccagtggatgaccacggaggacatgctgaccgtgtggaaccgcgtctggatcgaggacaacccctggatggaggacaagacccccatcaccacgtgggagaacgtgccgtacctcggcaagcgggaggaccagtggtgcgggagcctgatcggcctgacctcccgcgccacctgggcgcagaacatccccaccgccatccagcaggtccggagcctcatcgggaacgaggagttcctggactacatgccctccatgaagcgcttccggaaggaggaggagagcgagggcgccatctggtga

SEQ ID NO: 9857 - RNA, 9873 nt, synthetic construct
  misc_feature 1..9873: note = derived and/or modified CDS sequence (opt1) from DENV-3__KX380842__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccaggggatcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgcgccgtgcaagatccccttcagcaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgtgggcgcctgggagaacggggtctgcggcatccgcagcacgacccggatggagaacctgctgtggaagcagatcgcgaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgccgacatgggctactggatcgagagccagaagaacgggtcctggaagctcgagaaggcgagcctgatcgaggtcaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtggtcatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtctccgccggcagcgggaaggtggacaacttcaccatgggcgtgctgtgcctggccatcctcttcgaggaggtcatgcgggggaagttcggcaagaagcacatgatcgcgggggtgttcttcaccttcgtgctgctgctctccggccagatcacctggcgcgacatggcccacacgctgatcatgatcggcagcaacgcctccgaccggatggggatgggcgtcacctacctggccctcatcgccaccttcaagatccagcccttcctggcgctggggttcttcctccgcaagctgaccagccgggagaacctgctcctgggcgtgggcctggccatggccacgaccctccagctgcccgaggacatcgagcagatggccaacgggatcgcgctgggcctcatggccctgaagctgatcacccagttcgagacctaccagctctggacggccctgatcagcctgacctgctccaacaccatcttcaccctcacggtggcctggcgcaccgccaccctgatcctggcgggggtcagcctcctgccggtgtgccagtccagctccatgcggaagaccgactggctgcccatgacggtcgccgccatgggcgtgccgcccctcccgctgttcatcttcagcctgaaggacaccctcaagcgccgctcctggcccctgaacgagggggtgatggccgtcggcctggtgagcatgctcgcctccagcctgctgcggaacgacgtgcccatggcgggccccctcgtcgccgggggcctgctgatcgcctgctacgtgatcaccgggacctccgccgacctcacggtggagaaggccgcggacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggccgagctggaggagggggtgtaccgcatcaagcagcagggcatcctggggaagacccaggtcggcgtgggggtgcagaaggacggcgtcttccacacgatgtggcacgtgacccggggcgcggtgctcacccacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtccgggaggcgatcaagcgccggctccgcaccctgatcctggcccccacccgggtggtggccgccgagatggaggaggccctcaaggggctgcccatccgctaccagacgaccgcgaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtgcccagcatcaaggcgggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccatggccgccatcatcgccgcgaacgagatgggcctgctggagaccacgaagcgggacctcggcatgtccaaggagccgggggtggtgagccccacctcctacctggacgtcgacctgcaccccgccagcgcctggaccctctacgccgtggcgaccacggtgatcacccccatgctgcgccacaccatcgagaactccaccgccaacgtcagcctggccgccatcgccaaccaggcggtggtgctcatgggcctggacaaggggtggccgatctccaagatggacctgggcgtccccctcctggccctggggtgctacagccaggtgaaccccctcacgctgaccgccgccgtgctgctcctggtcacccactacgccatcatcggccccggcctgcaggcgaaggccacccgggaggcccagaagcgcacggccgccgggatcatgaagaacccgaccgtggacggcatcatcaccatcgacctcgaccccgtgatctacgactccaagttcgagaagcagctggggcaggtcatgctgctcgtgctgtgcgcggtgcagctgctcctgatgcggaccagctgggccctgtgcgaggccctcacgctggccaccggccccatcaccaccctgtgggagggctcccccgggaagttctggaacacgaccatcgcggtcagcatggccaacatcttccgcggctcctacctcgccggggccggcctggccttcagcatcatgaagtccgtggggaccggcaagcggggcaccgggagccagggcgagaccctgggggagaagtggaagaagaagctcaaccagctgagccgcaaggagttcgacctgtacaagaagtccggcatcacggaggtggaccggaccgaggcgaaggaggggctcaagcgcggcgagaccacccaccacgccgtcagccggggctccgccaagctgcagtggttcgtggagcgcaacatggtgatcccggaggggcgggtcatcgacctgggctgcgggcgcggcgggtggagctactactgcgccggcctcaagaaggtgacggaggtgcggggctacaccaagggcgggcccgggcacgaggagcccgtccccatgtccacctacggctggaacatcgtgaagctgatgagcgggaaggacgtgttctacctgccgcccgagaagtgcgacaccctcctgtgcgacatcggcgagtccagcccctcccccacggtcgaggagagccgcaccatccgcgtgctgaagatggtggagccgtggctgaagaacaaccagttctgcatcaaggtcctcaacccctacatgcccgccgtgatcgagcacctggagcggctgcagcgcaagcacggcgggatgctcgtgcggaaccccctgtcccgcaacagcacccacgagatgtactggatctccaacggcaccgggaacatcgtcagctccgtgaacatggtgagccggctgctcctgaaccgcttcacgatgacccaccggcgcccgaccatcgagaaggacgtcgacctgggcgcgggcacccggcacgtgaacgccgagcccgagacgcccaacatggacgtgatcggggagcgcatcaagcggatcaaggaggagcacaactccacctggcactacgacgacgagaacccgtacaagacctgggcctaccacggcagctacgaggtcaaggccaccgggtccgccagcagcatgatcaacggcgtggtcaagctcctgacgaagccctgggacgtggtgcccatggtcacccagatggcgatgaccgacaccacgcccttcgggcagcagcgcgtgttcaaggagaaggtggacacccggaccccgcgccccatgcccggcacccggaaggtcatggagatcacggccgagtggctgtggcgcaccctcggccggaacaagcgcccccggctgtgcacccgcgaggagttcaccaagaaggtgcgcacgaacgccgccatgggggcggtgttcaccgaggagaaccagtgggactccgccaaggccgccgtcgaggacgaggagttctggaagctggtggaccgggagcgcgagctccacaagctgggcaagtgcgggagctgcgtgtacaacatgatgggcaagcgggagaagaagctgggggagttcggcaaggccaagggctcccgcgcgatctggtacatgtggctcggggcccggtacctggagttcgaggccctgggcttcctcaacgaggaccactggttcagccgcgagaactcctacagcggggtcgagggcgaggggctgcacaagctgggctacatcctccgggacatctccaagatcccgggcggggccatgtacgccgacgacaccgcgggctgggacacccgcatcacggaggacgacctgcacaacgaggagaagatcacccagcagatggaccccgagcaccggctgctcgccaacgccatcttcaagctgacctaccagaacaaggtggtgaaggtccagcgccccacccccaccgggacggtgatggacatcatcagccggaaggaccagcgcggctccggccaggtggggacctacggcctgaacaccttcaccaacatggaggcccagctcgtccggcagatggagggggagggcgtgctgagcaagacggacctggagaacccgcacctccccgagaagaagatcacccagtggctggagaccaagggggtggagcgcctgaagcggatggccatctccggcgacgactgcgtcgtgaagcccatcgacgaccgcttcgcgaacgccctcctggccctgaacgacatgggcaaggtgcggaaggacatcccccagtggcagccgagcaaggggtggcacgactggcagcaggtccccttctgctcccaccacttccacgagctcatcatgaaggacggccgcaagctggtggtgccctgccggccccaggacgagctgatcgggcgcgcccggatcagccagggcgccgggtggtccctccgcgagaccgcgtgcctgggcaaggcctacgcccagatgtggagcctgatgtacttccaccgccgggacctccgcctggcctccaacgcgatctgcagcgccatcccggtccactgggtgcccacgtcccggaccacctggagcatccacgcccaccaccagtggatgaccacggaggacatgctgaccgtgtggaaccgcgtctggatcgaggacaacccctggatggaggacaagacccccatcaccacgtgggagaacgtgccgtacctcggcaagcgggaggaccagtggtgcgggagcctgatcggcctgacctcccgcgccacctgggcccagaacatccccaccgcgatccagcaggtccggagcctcatcgggaacgaggagttcctggactacatgccctccatgaagcgcttccggaaggaggaggagagcgagggcgccatctggtga

SEQ ID NO: 9858 - RNA, 9873 nt, synthetic construct
  misc_feature 1..9873: note = derived and/or modified CDS sequence (opt1) from DENV-3__KX380839__SS-prME
  source 1..9873: mol_type = other RNA
accagcctgtgcctcatgatgatgctgcccgccaccctggccttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccatcacgtacaagtgccccctgatcaccgaggtggagcccgaggacatcgactgctggtgcaacctcaccagcacctgggtgacgtacgggacctgcaaccaggccggcgagcaccggcgcgacaagcggagcgtggccctggcgccccacgtgggcatggggctggacacccgcgcgcagacctggatgagcgccgagggcgcctggcgccaggtggagaaggtggagacgtgggccttccgccaccccgggttcaccatcctcgcgctgttcctggcccactacatcggcaccagcctcacccagaaggtcgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagctcacggagggcaaggtggtccagcacgagaacctgaagtacaccgtgatcatcaccgtgcacaccggggaccagcaccaggtcggcaacgagacgcagggggtgaccgccgagatcacgccccaggccagcaccgtcgaggcgatcttccgctcctacggcaccctggggctcgagtgcagcccccggacgggcctggacttcaacgagatgatcctgctcaccatgaagaacaaggcctggatggtgcaccgccagtggttcttcgacctgcccctgccgtggacctccggcgccaccacggagacccccacctggaacaagaaggagctcctggtgaccttcaagaacgcccacgccaagaagcaggaggtcgtggtgctggggagccaggagggcgcgatgcacacggccctcaccggggccaccgagatccagacctccggcgggacgagcatcttcgccggccacctgaagtgccggctgaagatggacaagctcgagctgaagggcatgtcctacgccatgtgcagcaacgcgttcgtcctgaagaaggaggtgagcgagacccagcacgggaccatcctcatcaaggtggagtacaagggcgaggacgccccctgcaagatccccttctccaccgaggacgggcagggcaaggcccacaacggccgcctgatcacggccaacccggtcgtgaccaagaaggaggagcccgtgaacatcgaggcggagccgcccttcggggagagcaacatcatcatcggcatcggggacaaggccctgaagatcaactggtacaagaagggctccagcatcgggaagatgttcgaggccaccgcccggggcgcccgccggatggcgatcctgggcgacaccgcctgggacttcgggtccgtcggcggggtgctcaacagcctgggcaagatggtgcaccagatcttcgggtccgcctacacggccctgttcagcggcgtctcctggatcatgaagatcggcatcggggtgctcctgacctggatcggcctgaacagcaagaacacctccatgagcttctcctgcatcgtgatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactccccgaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcatcctcgagcagggcaagcgcaccctgacgccccagcccatggagctgaagtactcctggaagacctgggggaaggccaagatcgtcaccgccgagacccagaacagctccttcatcatcgacggccccaacacgccggagtgccccaacgcgagccgggcctggaacgtgtgggaggtggaggactacgggttcggcgtcttcaccaccaacatctggctcaagctgcgcgagatgtacacccagctgtgcgaccaccggctcatgagcgccgccgtgaaggacgagcgcgccgtgcacgcggacatgggctactggatcgagtcccagaagaacgggagctggaagctggagaaggcctccctgatcgaggtcaagacctgcacgtggcccaagagccacaccctctggtccaacggcgtgctggagagcgacatgatcatccccaagtccctggccgggccgatcagccagcacaactaccggcccggctaccacacccagaccgccgggccctggcacctcggcaagctggagctggacttcaactactgcgagggcacgaccgtggtcatcaccgagaactgcgggacccgcggcccgtccctccggacgaccaccgtgagcgggaagctgatccacgagtggtgctgccgctcctgcaccctgccgcccctccggtacatgggcgaggacgggtgctggtacggcatggagatccgccccatcaacgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgctgttcaccttcgtgctcctgctgtccggccagatcacctggcgcgacatggcccggaccctcatcatgatcggcagcaacgcctccgaccgcatggggatgggcgtcacgtacctggccctgatcgcgaccttcaagatccagccgttcctcgccctggggttcttcctgcggaagctcaccagccgcgagaacctgctgctcggcgtgggcctggccatggccaccacgctgcagctccccgaggacatcgagcagatggcgaacgggatcgccctgggcctgatggccctcaagctgatcacccagttcgagacctaccagctgtgggccgccctcgtgagcctgatgtgctccaacaccatcttcacgctgaccgtcgcgtggcggaccgccaccctcatcctggccgggatcagcctgctccccatgtgccagtccagctccatgcgcaagacggactggctgcccatgaccgtggccgccatgggcgtgccgcccctgcccctcttcatcttcagcctgaaggacaccctgaagcgccggtcctggcccctcaacgagggggtcatggcggtgggcctggtcagcatcctggcctccagcctcctgcgcaacgacgtgccgatggccggccccctggtggccgggggcctcctgatcgcctgctacgtcatcaccgggacgtccgcggacctgaccgtggagaaggccgccgacgtgacctgggaggaggaggccgagcagaccggcgtcagccacaacctcatgatcacggtggacgacgacgggaccatgcggatcaaggacgacgagaccgagaacatcctgaccgtgctgctcaagaccgccctgctgatcgtctccggcatcttcccctacagcatccccgcgacgctcctggtgtggcacacctggcagaagcagacccagcgctccggcgtgctgtgggacgtcccgtccccgcccgagacccagaaggccgagctcgaggagggggtgtaccggatcaagcagcagggcatcttcgggaagacccaggtgggcgtcggggtgcagaaggagggcgtgttccacaccatgtggcacgtcacccgcggcgccgtgctgacccacaacgggaagcggctggagcccaactgggcctccgtgaagaaggacctcatcagctacggcgggggctggcgcctgtccgcgcagtggcagaagggggaggaggtccaggtgatcgccgtggagccgggcaagaaccccaagaacttccagacgatgcccggcatcttccagaccaccaccggggagatcggcgccatcgccctggacttcaagcccgggacgagcggcagcccgatcatcaaccgggagggcaaggtcgtggggctgtacggcaacggggtggtcaccaagaacggcgggtacgtgtccggcatcgcccagaccaacgcggagcccgacggccccaccccggagctcgaggaggagatgttcaagaagcgcaacctgacgatcatggacctgcaccccgggagcggcaagacccggaagtacctccccgccatcgtgcgcgaggccatcaagcggcgcctgcggaccctgatcctcgcccccacccgcgtcgtggccgcggagatggaggaggccctgaaggggctgccgatccggtaccagacgaccgccaccaagtccgagcacaccggcaaggagatcgtggacctcatgtgccacgccacgttcaccatgcgcctgctgagccccgtccgggtgcccaactacaacctcatcatcatggacgaggcccacttcaccgaccccgcgtccatcgccgcccgcgggtacatcagcacccgggtgggcatgggcgaggccgcggccatcttcatgacggccaccccgcccgggaccgccgaggccttcccccagtccaacgcgcccatccaggacgaggagcgcgacatcccggagcgcagctggaactccggcaacgactggatcaccgacttcgccgggaagacggtctggttcgtgcccagcatcaaggccggcaacgacatcgccaactgcctgcggaagaacgggaagaaggtgatccagctgtcccgcaagaccttcgacaccgagtaccagaagaccaagctcaacgactgggacttcgtcgtgacgaccgacatcagcgagatgggcgccaacttcaaggcggaccgggtgatcgacccccgccggtgcctgaagcccgtcatcctgaccgacggcccggagcgcgtgatcctcgccgggcccatgcccgtgaccgtcgcctccgccgcccagcggcgcggccgggtggggcgcaacccccagaaggagaacgaccagtacatcttcacgggccagccgctgaacaacgacgaggaccacgcgcactggaccgaggccaagatgctgctcgacaacatcaacacccccgaggggatcatccccgccctgttcgagcccgagcgggagaagtccgccgcgatcgacggcgagtaccgcctgaagggcgagtcccggaagaccttcgtggagctcatgcgccgcggggacctgccggtctggctggcccacaaggtggccagcgagggcatcaagtacaccgaccgcaagtggtgcttcgacggggagcggaacaaccagatcctcgaggagaacatggacgtggagatctggacgaaggagggcgagaagaagaagctgcgcccccggtggctggacgcccgcacctactccgaccccctcgccctgaaggagttcaaggacttcgcggccggccgcaagagcatcgccctggacctcgtcaccgagatcgggcgggtgcccccgcacctggcccaccgcacccggaacgccctggacaacctcgtcatgctgcacacgtccgagtacggcgggcgcgcgtaccggcacgccgtggaggagctgcccgagaccatggagaccctcctgctgctcggcctgatgatcctgctcaccgggggcgtgatgctgttcctgatcagcggcaagggggtcggcaagacgagcatcgggctcatctgcgtggtggcctccagcggcatgctgtggatggccgacatccccctgcagtggatcgcctccgcgatcgtcctcgagttcttcatgatggtgctgctgatcccggagcccgagaagcagcgcacgccccaggacaaccagctcgcctacgtggtcatcgggatcctgaccctggccgccatcgtggccgcgaacgagatgggcctcctggagaccacgaagcgggacctgggcatgagcaaggagcccggggtggtctccccgaccagctacctcgacgtggacctgcaccccgcctccgcctggaccctgtacgccgtggcgaccacggtcatcacccccatgctccgccacaccatcgagaacagcaccgccaacgtgtccctggccgccatcgccaaccaggcggtggtcctgatgggcctcgacaaggggtggcccatcagcaagatggacctgggcgtgccgctgctcgccctggggtgctactcccaggtgaaccccctgacgctcaccgccgccgtcctgctgctcgtgacccactacgccatcatcggccccggcctgcaggcgaaggccacccgggaggcccagaagcgcacggccgccgggatcatgaagaaccccaccgtggacggcatcatgaccatcgacctggacccggtcatctacgacagcaagttcgagaagcagctcggccaggtgatgctgctggtgctctgcgcggtccagctgctgctcatgcggacctcctgggccttctgcgaggccctgacgctggccaccggccccatcaccaccctctgggagggcagccccgggaagttctggaacacgaccatcgcggtgtccatggccaacatcttccgcggcagctacctggccggggccggcctggccttctccatcatgaagtccgtggggaccggcaagcggggcaccgggtcccagggcgagacgctcggggagaagtggaagaagaagctgaaccagctgagccgcaaggagttcgacctctacaagaagtccggcatcaccgaggtcgaccggaccgaggcgaaggaggggctgaagcgcggcgagatcacccaccacgccgtgtcccggggcagcgccaagctgcagtggttcgtggagcgcaacatggtcatccccgaggggcgggtgatcgacctcggctgcgggcgcggcgggtggtcctactactgcgccggcctgaagaaggtgaccgaggtccggggctacacgaagggcgggccggggcacgaggagcccgtgcccatgagcacctacggctggaacatcgtgaagctgatctccgggaaggacgtcttctacctcccgcccgagaagtgcgacaccctgctgtgcgacatcggcgagagctcccccagccccaccgtggaggagtcccgcacgatccgcgtgctgaagatggtcgagccctggctcaagaacaaccagttctgcatcaaggtgctgaacccctacatgcccgccgtgatcgagcacctggagcggctccagcgcaagcacggcgggatgctggtccggaaccccctgagccgcaactccacccacgagatgtactggatcagcaacggcaccgggaacatcgtgtccagcgtgaacatgatctcccggctcctgctgaaccgcttcaccatgacgtaccggcgccccaccatcgagaaggacgtcgacctcggcgcgggcacccggcacgtgaacgccgagccggagacccccaacatggacgtgatcggggagcgcatccggcgcatcaaggaggagcacagctccacgtggcactacgacgacgagaacccctacaagacctgggcctaccacggcagctacgaggtcaaggccaccgggtccgccagcagcatgatcaacggcgtggtcaagctgctgaccaagccgtgggacgtggtgcccacggtcacccagatggcgatgaccgacaccacgcccttcgggcagcagcgggtgttcaaggagaaggtggacacccgcacccccaagccgatgcccggcacccggaaggtcatggagatcacggccgagtggctctggcgcaccctgggccggaacaagcgcccccggctgtgcacccgcgaggagttcaccaagaaggtgcgcacgaacgccgccatgggggcggtgttcaccgaggagaaccagtgggactccgcccgggccgccgtcgaggacgaggagttctggaagctcgtggaccgcgagcgggagctgcacaagctgggcaagtgcgggagctgcgtgtacaacatgatgggcaagcgcgagaagaagctcggggagttcggcaaggccaagggctcccgggcgatctggtacatgtggctgggggcccgctacctggagttcgaggccctcggcttcctgaacgaggaccactggttcagccgggagaactcctacagcggggtcgagggcgaggggctgcacaagctcggctacatcctgcgcgacatctccaagatccccggcggggccatgtacgccgacgacaccgcgggctgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaaggggacggtgatggacatcatcagccgcaaggaccagcggggctccggccaggtggggacctacggcctgaacaccttcaccaacatggaggcccagctcatccgccagatggagggggagggcgtcctgagcaagaccgacctggagaacccccacctcctggagaagaagatcacgcagtggctggagaccaagggggtggagcggctcaagcgcatggccatctccggcgacgactgcgtggtcaagccgatcgacgaccggttcgcgaacgccctgctggccctcaacgacatgggcaaggtgcgcaaggacatcccccagtggcagcccagcaaggggtggcacgactggcagcaggtccccttctgctcccaccacttccacgagctgatcatgaaggacggccggaagctggtcgtgccgtgccgcccccaggacgagctcatcgggcgggcccgcatcagccagggcgccgggtggtccctgaaggagaccgcgtgcctgggcaaggcctacgcccagatgtgggccctcatgtacttccaccgccgggacctgcgcctggcgagcaacgccatctgctccgccgtgcccgtccactgggtgcccaccagccggacgacctggtccatccacgcccaccaccagtggatgaccaccgaggacatgctcacggtgtggaaccgcgtctggatcgaggacaacccgtggatggaggacaagacccccgtgaccacctgggaggacgtgccctacctgggcaagcgggaggaccagtggtgcgggagcctgatcggcctcacgagccgcgccacctgggcgcagaacatcctgaccgccatccagcaggtccggtccctgatcgggaacgaggagttcctcgactacatgcccagcatgaagcgcttccggaaggaggaggagtccgagggcgccatctggtga

SEQ ID NO: 9859 - RNA, 9873 nt, synthetic construct
  misc_feature 1..9873: note = derived and/or modified CDS sequence (opt1) from DENV-3__KX380840__SS-prME
  source 1..9873: mol_type = other RNA
acctccctgtgcctcatgatgatgctgcccgccaccctggccttccacctcacctcccgggacggggagccccggatgatcgtggggaagaacgagcggggcaagagcctgctgttcaagaccgcctccgggatcaacatgtgcaccctcatcgccatggacctgggcgagatgtgcgacgacaccatcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtggagacgtgggccttccgccaccccgggttcaccatcctcgcgctgttcctggcccactacatcggcacctccctcacccagaaggtcgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccaccctgcccgaggagcaggaccagaactacgtgtgcaagcacacctacgtcgaccgggggtggggcaacgggtgcggcctcttcgggaagggctccctggtgacctgcgccaagttccagtgcctggagctcacggagggcaaggtggtccagcacgagaacctgaagtacaccgtgatcatcaccgtgcacaccggggaccagcaccaggtcggcaacgagacgcagggggtgaccgccgagatcacgccccaggccagcaccgtcgaggcgatcttccgctcctacggcaccctggggctcgagtgcagcccccggacgggcctggacttcaacgagatgatcctgctcaccatgaagaacaaggcctggatggtgcaccgccagtggttcttcgacctgcccctgccgtggacctccggcgccaccacggagacccccacctggaacaagaaggagctcctggtgaccttcaagaacgcccacgccaagaagcaggaggtcgtggtgctggggagccaggagggcgcgatgcacacggccctcaccggggccaccgagatccagacctccggcgggacgagcatcttcgccggccacctgaagtgccggctgaagatggacaagctcgagctgaagggcatgtcctacgccatgtgcagcaacgcgttcgtcctgaagaaggaggtgagcgagacccagcacgggaccatcctcatcaaggtggagtacaagggcgaggacgccccctgcaagatccccttctccaccgaggacgggcagggcaaggcccacaacggccgcctgatcacggccaacccggtcgtgaccaagaaggaggagcccgtgaacatcgaggcggagccgcccttcggggagagcaacatcatcatcggcatcggggacaaggccctgaagatcaactggtacaagaagggctccagcatcgggaagatgttcgaggccaccgcccggggcgcccgccggatggcgatcctgggcgacaccgcctgggacttcgggtccgtcggcggggtgctcaacagcctgggcaagatggtgcaccagatcttcgggtccgcctacacggccctgttcagcggcgtctcctggatcatgaagatcggcatcggggtgctcctgacctggatcggcctgaacagcaagaacacctccatgagcttctcctgcatcgtgatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactccccgaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcatcctcgagcagggcaagcgcaccctgacgccccagcccatggagctgaagtactcctggaagacctgggggaaggccaagatcgtcaccgccgagacccagaacagctccttcatcatcgacggccccaacacgccggagtgccccaacgcgctccgggcctggaacgtgtgggaggtggaggactacgggttcggcgtcttcaccaccaacatctggctgaagctgcgcgagatgtacacccagctctgcgaccaccggctgatgagcgccgccgtgaaggacgagcgcgccgtgcacgcggacatgggctactggatcgagagccagaagaacgggtcctggaagctggagaaggccagcctcatcgaggtcaagacctgcacgtggcccaagtcccacaccctgtggagcaacggcgtgctggagtccgacatgatcatccccaagagcctcgccgggccgatctcccagcacaactaccggcccggctaccacacccagaccgccgggccctggcacctgggcaagctggagctcgacttcaactactgcgagggcacgaccgtggtcatcaccgagaactgcgggacccgcggcccgagcctgcggacgaccaccgtgtccgggaagctgatccacgagtggtgctgccgcagctgcaccctgccgcccctccggtacatgggcgaggacgggtgctggtacggcatggagatccgccccatcaacgagaaggaggagaacatggtgaagtccctggtcagcgccggctccgggaaggtggacaacttcacgatgggcgtgctctgcctggcgatcctgttcgaggaggtcatgcgggggaagttcggcaagaagcacatgatcgccggggtcctgttcaccttcgtgctgctgctcagcggccagatcacctggcgcgacatggcccggaccctgatcatgatcggctccaacgccagcgaccgcatggggatgggcgtcacgtacctggccctcatcgcgaccttcaagatccagccgttcctggccctggggttcttcctccggaagctgacctcccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctgggccgccctggtgagcctgatgtgcagcaacaccatcttcacgctcaccgtcgcgtggcggaccgccaccctgatcctggccgggatctccctcctgcccatgtgccagagctccagcatgcgcaagacggactggctgcccatgaccgtggccgccatgggcgtgccgcccctccccctgttcatcttctccctgaaggacaccctcaagcgccggagctggcccctgaacgagggggtcatggcggtgggcctggtctccatcctcgccagctccctgctgcgcaacgacgtgccgatggccggccccctcgtggccgggggcctgctgatcgcctgctacgtcatcaccgggacgagcgcggacctcaccgtggagaaggccgccgacgtgacctgggaggaggaggccgagcagaccggcgtctcccacaacctgatgatcacggtggacgacgacgggaccatgcggatcaaggacgacgagaccgagaacatcctgaccgtgctcctgaagaccgccctgctcatcgtcagcggcatcttcccctactccatccccgcgacgctgctggtgtggcacacctggcagaagcagacccagcgcagcggcgtgctctgggacgtcccgagcccgcccgagacccagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctgacccacaacgggaagcggctcgagcccaactgggccagcgtgaagaaggacctgatctcctacggcgggggctggcgcctgagcgcgcagtggcagaagggggaggaggtccaggtgatcgccgtggagccgggcaagaaccccaagaacttccagacgatgcccggcatcttccagaccaccaccggggagatcggcgccatcgccctggacttcaagcccgggacgtccggcagcccgatcatcaaccgggagggcaaggtcgtggggctctacggcaacggggtggtcaccaagaacggcgggtacgtgagcggcatcgcccagaccaacgcggagcccgacggccccaccccggagctggaggaggagatgttcaagaagcgcaacctgacgatcatggacctccaccccgggtccggcaagacccggaagtacctgcccgccatcgtgcgcgaggccatcaagcggcgcctgcggaccctcatcctggcccccacccgcgtcgtggccgcggagatggaggaggccctgaaggggctcccgatccggtaccagacgaccgccaccaagagcgagcacaccggcaaggagatcgtggacctgatgtgccacgccacgttcaccatgcgcctgctctcccccgtccgggtgcccaactacaacctgatcatcatggacgaggcccacttcaccgaccccgcgagcatcgccgcccgcgggtacatctccacccgggtgggcatgggcgaggccgcggccatcttcatgacggccaccccgcccgggaccgccgaggccttcccccagagcaacgcgcccatccaggacgaggagcgcgacatcccggagcgctcctggaacagcggcaacgactggatcaccgacttcgccgggaagacggtctggttcgtgccctccatcaaggccggcaacgacatcgccaactgcctgcggaagaacgggaagaaggtgatccagctcagccgcaagaccttcgacaccgagtaccagaagaccaagctgaacgactgggacttcgtcgtgacgaccgacatctccgagatgggcgccaacttcaaggcggaccgggtgatcgacccccgccggtgcctgaagcccgtcatcctcaccgacggcccggagcgcgtgatcctggccgggcccatgcccgtgaccgtcgccagcgccgcccagcggcgcggccgggtggggcgcaacccccagaaggagaacgaccagtacatcttcacgggccagccgctgaacaacgacgaggaccacgcgcactggaccgaggccaagatgctcctggacaacatcaacacccccgaggggatcatccccgccctgttcgagcccgagcgggagaagtccgccgcgatcgacggcgagtaccgcctcaagggcgagagccggaagaccttcgtggagctgatgcgccgcggggacctgccggtctggctcgcccacaaggtggcctccgagggcatcaagtacaccgaccgcaagtggtgcttcgacggggagcggaacaaccagatcctggaggagaacatggacgtggagatctggacgaaggagggcgagaagaagaagctgcgcccccggtggctcgacgcccgcacctacagcgaccccctggccctgaaggagttcaaggacttcgcggccggccgcaagtccatcgccctcgacctggtcaccgagatcgggcgggtgcccccgcacctggcccaccgcacccggaacgccctcgacaacctggtcatgctgcacacgagcgagtacggcgggcgcgcgtaccggcacgccgtggaggagctccccgagaccatggagaccctgctgctcctgggcctgatgatcctcctgaccgggggcgtgatgctgttcctcatctccggcaagggggtcggcaagacgagcatcgggctgatctgcgtggtggccagctccggcatgctgtggatggccgacatccccctccagtggatcgccagcgcgatcgtcctggagttcttcatgatggtgctgctcatcccggagcccgagaagcagcgcacgccccaggacaaccagctggcctacgtggtcatcgggatcctgaccctcgccgccatcgtggccgcgaacgagatgggcctgctggagaccacgaagcgggacctcggcatgtccaaggagcccggggtggtcagcccgacctcctacctggacgtggacctgcaccccgccagcgcctggaccctctacgccgtggcgaccacggtcatcacccccatgctgcgccacaccatcgagaactccaccgccaacgtgagcctggccgccatcgccaaccaggcggtggtcctcatgggcctggacaaggggtggcccatctccaagatggacctgggcgtgccgctcctggccctggggtgctacagccaggtgaaccccctcacgctgaccgccgccgtcctgctcctggtgacccactacgccatcatcggccccggcctgcaggcgaaggccacccgggaggcccagaagcgcacggccgccgggatcatgaagaaccccaccgtggacggcatcatgaccatcgacctcgacccggtcatctacgactccaagttcgagaagcagctgggccaggtgatgctgctcgtgctgtgcgcggtccagctgctcctgatgcggaccagctgggccttctgcgaggccctgacgctcgccaccggccccatcaccaccctgtgggagggctcccccgggaagttctggaacacgaccatcgcggtgagcatggccaacatcttccgcggctcctacctggccggggccggcctcgccttcagcatcatgaagtccgtggggaccggcaagcggggcaccgggagccagggcgagacgctgggggagaagtggaagaagaagctgaaccagctctcccgcaaggagttcgacctgtacaagaagtccggcatcaccgaggtcgaccggaccgaggcgaaggaggggctgaagcgcggcgagatcacccaccacgccgtgagccggggcagcgccaagctccagtggttcgtggagcgcaacatggtcatccccgaggggcgggtgatcgacctgggctgcgggcgcggcgggtggagctactactgcgccggcctgaagaaggtgaccgaggtccggggctacacgaagggcgggccggggcacgaggagcccgtgcccatgtccacctacggctggaacatcgtgaagctcatcagcgggaaggacgtcttctacctgcccccggagaagtgcgacaccctgctgtgcgacatcggcgagtccagcccctcccccaccgtggaggagagccgcacgatccgcgtgctcaagatggtcgagccctggctgaagaacaaccagttctgcatcaaggtgctgaacccgtacatgcccgccgtgatcgagcacctcgagcggctgcagcgcaagcacggcgggatgctggtccggaaccccctctcccgcaacagcacccacgagatgtactggatctccaacggcaccgggaacatcgtgagctccgtgaacatgatcagccggctgctgctcaaccgcttcaccatgacgtaccggcgccccaccatcgagaaggacgtcgacctgggcgcgggcacccggcacgtgaacgccgagccggagacccccaacatggacgtgatcggggagcgcatccggcgcatcaaggaggagcactccagcacgtggcactacgacgacgagaacccctacaagacctgggcctaccacggctcctacgaggtcaaggccaccgggagcgcctccagcatgatcaacggcgtggtcaagctgctcaccaagccgtgggacgtggtgcccacggtcacccagatggcgatgaccgacaccacgcccttcgggcagcagcgggtgttcaaggagaaggtggacacccgcacccccaagccgatgcccggcacccggaaggtcatggagatcacggccgagtggctgtggcgcaccctgggccggaacaagcgcccccggctctgcacccgcgaggagttcaccaagaaggtgcgcacgaacgccgccatgggggcggtgttcaccgaggagaaccagtgggacagcgcccgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgccgacgacaccgcgggctgggacacccggatcacggaggacgacctccacaacgaggagaagatcacccagcagatggacccggagcaccgccagctggccaacgccatcttcaagctgacctaccagaacaaggtggtgaaggtccagcggcccacccccaaggggacggtgatggacatcatctcccgcaaggaccagcggggcagcggccaggtggggacctacggcctcaacaccttcaccaacatggaggcccagctgatccgccagatggagggggagggcgtcctgtccaagaccgacctcgagaacccccacctcctggagaagaagatcacgcagtggctcgagaccaagggggtggagcggctgaagcgcatggccatcagcggcgacgactgcgtggtcaagccgatcgacgaccggttcgcgaacgccctgctcgccctgaacgacatgggcaaggtgcgcaaggacatcccccagtggcagccctccaaggggtggcacgactggcagcaggtccccttctgcagccaccacttccacgagctgatcatgaaggacggccggaagctcgtcgtgccgtgccgcccccaggacgagctgatcgggcgggcccgcatctcccagggcgccgggtggagcctgaaggagaccgcgtgcctcggcaaggcctacgcccagatgtgggccctgatgtacttccaccgccgggacctgcgcctcgcgtccaacgccatctgcagcgccgtgcccgtccactgggtgcccacctcccggacgacctggagcatccacgcccaccaccagtggatgaccaccgaggacatgctgacggtgtggaaccgcgtctggatcgaggacaacccgtggatggaggacaagacccccgtgaccacctgggaggacgtgccctacctgggcaagcgggaggaccagtggtgcgggtccctcatcggcctgacgagccgcgccacctgggcgcagaacatcctgaccgccatccagcaggtccggagcctcatcgggaacgaggagttcctggactacatgccctccatgaagcgcttccggaaggaggaggagagcgagggcgccatctggtga

SEQ ID NO: 9860 - RNA, 9873 nt, synthetic construct
  misc_feature 1..9873: note = derived and/or modified CDS sequence (opt1) from DENV-3__JF808121__SS-prME
  source 1..9873: mol_type = other RNA
acctccctgtgcctcatgatgatcctgcccgccgccctggcgttccacctcacctcccgcgacggggagccccggatgatcgtggggaagaacgagcgcggcaagagcctgctgttcaagaccgcctccgggaccaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacctggatgagcgccgagggcgcctggcgccaggtggagaaggtggagacctgggccctgcggcaccccgggttcaccatcctcgcgctgttcctggcccactacatcggcacctccctcacccagaaggtggtgatcttcatcctgctgatgctcgtcacccccagcatgaccatgcgctgcgtgggggtgggcaaccgggacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccgcaagctgtgcatcgagggcaagatcaccaacatcaccacggacagccggtgccccacccagggcgaggccgtgctgcccgaggagcaggaccagaactacgtctgcaagcacacctacgtggaccgcgggtggggcaacgggtgcggcctcttcgggaagggctccctggtgacctgcgccaagttccagtgcctggagctcatcgagggcaaggtcgtgcagtacgagaacctgaagtacacggtgatcatcaccgtccacaccggggaccagcaccaggtgggcaacgagacccagggggtcacggccgagatcacgccccaggccagcaccaccgaggcgatcctgcccgagtacggcaccctcgggctggagtgcagcccccggacgggcctggacttcaacgagatgatcctcctgaccatgaagaacaaggcctggatggtgcaccgccagtggttcttcgacctgccgctcccctggaccagcggcgccaccacggagacccccacctggaaccggaaggagctgctggtgaccttcaagaacgcccacgccaagaagcaggaggtcgtggtgctcgggtcccaggagggcgcgatgcacacggccctgaccggggccaccgagatccagaacagcggcgggacctccatcttcagcggccacctgaagtgccgcctcaagatggacaagctggagctgaagggcatgtcctacgccatgtgcacgaacaccttcgtcctcaagaaggaggtgagcgagacccagcacgggaccatcctgatcaaggtggagtacaagggcgaggacgccccctgcaagatcccgttcagcacggaggacgggcagggcaaggcgcacaacggccggctgatcaccgccaaccccgtcgtgaccaagaaggaggagcccgtgaacatcgaggccgagcccccgttcggggagtccaacatcgtcatcggcaccggggacaacgccctgaagatcaactggtacaagaagggcagctccatcgggaagatgttcgaggcgacggcccgcggcgcccggcgcatggccatcctcggcgacaccgcctgggacttcgggagcgtgggcggggtgctgaactccctgggcaagatggtccaccagatcttcgggagcgcgtacaccgccctcttctccggcgtgagctgggtgatgaagatcggcatcggggtcctgctgacctggatcggcctcaactccaagaacacgagcatgtccttcagctgcatcgccatcgggatcatcaccctgtacctgggcgccgtggtgcaggccgacatggggtgcgtcatcaactggaagggcaaggagctcaagtgcggctccgggatcttcgtgaccaacgaggtgcacacctggacggagcagtacaagttccaggcggacagccccaagcgcctggccaccgccatcgccggcgcctgggagaacggggtctgcggcatccggtccaccacccgcatggagaacctgctctggaagcagatcgcgaacgagctgaactacatcctgtgggagaacaacatcaagctcacggtggtggtcggggacatcatcggcgtgctggagcagggcaagcggaccctgacgccccagcccatggagctcaagtacagctggaagacctgggggaaggccaagatcgtgacggccgagacccagaactccagcttcatcatcgacggcccgaacacccccgagtgcccctccgccagccgcgcgtggaacgtctgggaggtggaggactacgggttcggcgtgttcaccaccaacatctggctgaagctgcgggaggtctacacgcagctctgcgaccaccgcctgatgagcgccgccgtgaaggacgagcgggccgtgcacgccgacatgggctactggatcgagtcccagaagaacgggagctggaagctggagaaggcgtccctcatcgaggtcaagacctgcacctggcccaagagccacaccctgtggtccaacggcgtgctggagagcgacatgatcatcccgaagtccctcgccgggcccatcagccagcacaaccaccgccccggctaccacacgcagaccgccgggccgtggcacctgggcaagctggagctcgacttcaactactgcgagggcaccaccgtggtcatcacggagaactgcgggacccggggcccctccctgcgcaccaccacggtgagcgggaagctgatccacgagtggtgctgccggtcctgcaccctgccgcccctccgctacatgggcgaggacgggtgctggtacggcatggagatccggccgatcagcgagaaggaggagaacatggtgaagtccctggtcagcgccggctccgggaaggtggacaacttcaccatgggcgtgctctgcctggccatcctgttcgaggaggtcatgcgcgggaagttcggcaagaagcacatgatcgcgggggtgttcttcaccttcgtgctcctgctgagcggccagatcacgtggcgggacatggcccacaccctcaccatgatcggctccaacgccagcgaccgcatggggatgggcgtcacctacctggccctgatcgccacgttcaagatccagcccttcctcgcgctggggttcttcctgcggaagctcaccagccgcgagaacctgctgctcggcgtgggcctggccatggccaccaccctgcagctccccgaggacatcgagcagatggccaacgggatcgcgctgggcctgatggccctcaagctgatcacgcagttcgagacctaccagctgtggatcgccctcatctccctgacctgcagcaacaccatgttcacgctgaccgtggcctggcggaccgccaccctcatcctggcgggggtctccctgctccccgtgtgccagagctccagcatgcgcaagacggactggctgccgatggccgtcgccgccatgggcgtgccgcccctgcccctcttcatcttctccctgaaggacaccctgaagcgccggagctggccgctcaacgagggggtgatggccgtcggcctggtgtccatcctggcgagctccctcctgcgcaacgacgtgcccatggccggccccctggtcgccgggggcctcctgatcgcctgctacgtgatcaccgggaccagcgccgacctgacggtggagaaggcggccgacatcacctgggaggaggaggccgagcagaccggcgtctcccacaacctcatgatcaccgtggacgacgacgggaccatgcggatcaaggacgacgagacggagaacatcctgaccgtgctgctcaagaccgccctgctgatcgtcagcggcgtgttcccctactccatcccggccaccctcctggtgtggcacacgtggcagaagcagacccagcgcagcggcgtcctgtgggacgtgcccagcccgcccgagacccagaaggcggagctcgaggagggggtgtaccggatcaagcagcagggcatcttcgggaagacccaggtcggcgtgggggtgcagaaggagggcgtcttccacacgatgtggcacgtgacccgcggcgccgtgctgacctacaacgggaagcggctggagccgaactgggccagcgtcaagaaggacctcatctcctacggcgggggctggcgcctgagcgcccagtggcagaagggggaggaggtccaggtgatcgcggtcgagcccggcaagaaccccaagaacttccagaccatgcccggcacgttccagaccaccaccggggagatcggcgccatcgccctggacttcaagccggggacgagcggctcccccatcatcaaccgggagggcaaggtggtggggctgtacggcaacggggtcgtgaccaagaacggcgggtacgtgagcggcatcgcccagaccaacgccgagcccgacggcccgacccccgagctcgaggaggagatgttcaagaagcgcaacctgacgatcatggacctgcaccccgggtccggcaagacccggaagtacctccccgcgatcgtccgcgaggccatcaagcggcgcctgcggaccctgatcctcgccccgacccgcgtggtggccgccgagatggaggaggcgctgaaggggctgcccatccggtaccagacgaccgccaccaagagcgagcacaccggccgcgagatcgtcgacctcatgtgccacgccacgttcaccatgcggctgctgtcccccgtgcgcgtgcccaactacaacctcatcatcatggacgaggcccacttcaccgacccggccagcatcgcggcccgggggtacatctccacccgcgtcggcatgggcgaggccgccgcgatcttcatgacggccacgccgcccgggaccgccgacgccttcccccagagcaacgccccgatccaggacgaggagcgcgacatccccgagcggtcctggaacagcggcaacgagtggatcaccgacttcgcggggaagacggtgtggttcgtgccctccatcaaggccggcaacgacatcgccaactgcctgcgcaagaacgggaagaaggtcatccagctgagccggaagaccttcgacaccgagtaccagaagaccaagctcaacgactgggacttcgtggtgacgaccgacatctccgagatgggcgccaacttcaaggccgaccgcgtcatcgacccccggcgctgcctgaagccggtgatcctgaccgacggccccgagcgggtgatcctcgcggggcccatgcccgtcaccgccgccagcgccgcccagcgccggggccgcgtggggcggaacccgcagaaggagaacgaccagtacatcttcaccggccagcccctgaacaacgacgaggaccacgcgcactggacggaggccaagatgctgctcgacaacatcaacacccccgaggggatcatccccgccctgttcgagccggagcgcgagaagtccgccgcgatcgacggcgagtaccggctgaagggcgagagccgcaagaccttcgtggagctcatgcggcgcggggacctgcccgtctggctggcccacaaggtggcctccgagggcatcaagtacaccgaccggaagtggtgcttcgacgggcagcgcaacaaccagatcctcgaggagaacatggacgtcgagatctggacgaaggagggcgagaagaagaagctgcggccccgctggctggacgcccgcacctacagcgaccccctcgccctgaaggagttcaaggacttcgcggccggccggaagtccatcgccctggacctcgtgaccgagatcgggcgcgtgccgagccacctggcccaccggacccgcaacgccctggacaacctcgtcatgctgcacacgagcgagcacggcgggcgggcgtaccgccacgccgtggaggagctgcccgagaccatggagaccctcctgctgctcggcctgatgatcctgctcaccgggggcgccatgctgttcctgatctccggcaaggggatcggcaagacgagcatcgggctcatctgcgtgatcgcctccagcggcatgctgtggatggccgagatccccctgcagtggatcgcgtccgccatcgtcctcgagttcttcatgatggtgctgctgatcccggagcccgagaagcagcggacgccccaggacaaccagctcgcctacgtggtcatcgggatcctgaccctggccgccatcatcgcggccaacgagatgggcctcctggagaccacgaagcgcgacctgggcatgagcaaggagcccggggtggtgtccccgaccagctacctcgacgtcgacctgcaccccgcctccgcctggaccctgtacgcggtggccaccacggtgatcacccccatgctccggcacaccatcgagaacagcaccgccaacgtctccctggccgccatcgcgaaccaggccgtggtgctgatgggcctcgacaaggggtggcccatcagcaagatggacctgggcgtcccgctgctcgccctggggtgctactcccaggtgaaccccctgacgctcaccgccgccgtgctgctgctcatcacccactacgcgatcatcggccccggcctgcaggccaaggccacccgcgaggcccagaagcggacggccgcggggatcatgaagaaccccaccgtcgacggcatcatgaccatcgacctggacccggtgatctacgacagcaagttcgagaagcagctcggccaggtgatgctgctggtcctctgcgccgtgcagctgctgctcatgcgcacctcctgggccctgtgcgaggccctgacgctcgcgaccggccccatcaccaccctgtgggagggcagccccgggaagttctggaacacgaccatcgccgtgtccatggccaacatcttccggggcagctacctggccggggccggcctcgcgttctccatcatgaagtccgtcgggaccggcaagcgcggcaccgggagccagggcgagaccctgggggagaagtggaagaagaagctgaaccagctctcccggaaggagttcgacctgtacaagaagtccggcatcacggaggtggaccgcaccgaggccaaggaggggctgaagcggggcgagatcacccaccacgccgtgagccgcggcagcgccaagctccagtggttcgtcgagcggaacatggtgatccccgaggggcgcgtgatcgacctgggctgcgggcggggcgggtggtcctactactgcgccggcctgaagaaggtcaccgaggtgcgcggctacacgaagggcgggccggggcacgaggagcccgtgcccatgagcacctacggctggaacatcgtcaagctcatgtccgggaaggacgtgttctacctgcccccggagaagtgcgacaccctgctgtgcgacatcggcgagagctcccccagccccaccgtggaggagtcccgcacgatccgggtcctcaagatggtggagccctggctgaagaacaaccagttctgcatcaaggtgctgaacccgtacatgcccaccgtcatcgagcacctcgagcgcctgcagcggaagcacggcgggatgctggtgcgcaaccccctcagccggaactccacccacgagatgtactggatcagcaacggcaccgggaacatcgtggcgtccgtcaacatggtgagccgcctgctgctcaaccggttcacgatgaagcaccgccggcccaccatcgagaaggacgtggacctgggcgccggcacccgccacgtcaacgccgagccggagacccccaacatggacgtgatcggggagcggatcaagcgcatcaaggaggagcacaactccacgtggcactacgacgacgagaacccctacaagacctgggcctaccacggcagctacgaggtgaaggccaccgggtccgcgagcagcatgatcaacggcgtcgtgaagctgctcaccaagccgtgggacgtcgtgcccatggtgacgcagatggccatgaccgacaccacccccttcgggcagcagcgggtcttcaaggagaaggtggacacgcgcacgccccggtccatgccgggcacccgccgggtgatgggcatcaccgccgagtggctgtggaagacgctggggcgcaacaagaagccccggctctgcccccgcgaggagttcaccaagaaggtccgcaccaacgccgcgatgggcgccgtgttcaccgaggagaaccagtgggacagcgccaaggccgccgtggaggacgaggacttctggaagctggtcgaccgggagcgcgagctgcacaagctcgggaagtgcggctcctgcgtgtacaacatgatggggaagcgggagaagaagctgggcgagttcggcaaggcgaaggggagccgcgccatctggtacatgtggctgggcgcccggtacctcgagttcgaggccctggggttcctgaacgaggaccactggttctcccgcgagaacagctactccggcgtggagggggagggcctccacaagctgggctacatcctgcgggacatcagcaagatccccgggggcgccatgtacgcggacgacacggccgggtgggacacccgcatcaccgaggacgacctccacaacgaggagaagatcacccagcagatggacccggagcaccggcagctggccaacgccatcttcaagctgacgtaccagaacaaggtcgtgaaggtgcagcgccccacccccaccggcaccgtcatggacatcatctcccggaaggaccagcgcggcagcggccaggtgggcacctacgggctcaacacgttcaccaacatggaggcccagctgatccggcagatggagggcgagggggtgctgtccaaggcggacctcgagaacccccacctccccgagaagaagatcacccagtggctggagaccaagggcgtcgagcgcctgaagcggatggccatcagcggcgacgactgcgtggtgaagcccatcgacgaccgcttcgccaacgccctgctggccctcaacgacatggggaaggtccggaaggacatcccccagtggcagccctccaagggctggcacgactggcagcaggtcccgttctgcagccaccacttccacgagctgatcatgaaggacgggcgcaagctggtggtcccctgccggccccaggacgagctcatcggccgcgcgcggatctcccaggggagcggctggtccctgcgcgagacggcctgcctgggcaaggcctacgcccagatgtggagcctcatgtacttccaccgccgggacctgcgcctggcgtccaacgccatctgcagcgccgtgcccgtgcactgggtcccgaccagccggatgacctggtccatccacgcccaccaccagtggatgaccacggaggacatgctcaccgtgtggaaccgcgtgtggatcgaggacaacccctggatggaggacaagacccccgtcaccacgtgggagaacgtgccctacctggggaagcgggaggaccagtggtgcggcagcctgatcgggctcacctcccgcgccacctgggcgcagaacatcccgaccgccatccagcaggtccggagcctgatcggcaacgaggagttcctggactacatgccctccatgaagcgcttccggaaggaggaggagagcgagggggccatctggtga

SEQ ID NO: 9861 - RNA, 9873 nt, synthetic construct
  misc_feature 1..9873: note = derived and/or modified CDS sequence (opt1) from DENV-3__JF808120__SS-prME
  source 1..9873: mol_type = other RNA
accagcctgtgcctgatgatgatcctgcccgccgccctggcgttccacctcaccagccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtcgagacgtgggccctgcggcaccccgggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgcccgaggagcaggaccagaactacgtctgcaagcacacctacgtggaccgcgggtggggcaacgggtgcggcctcttcgggaagggctccctggtgacctgcgccaagttccagtgcctggagctcatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctgcccgagtacggcaccctcgggctggagtgcagcccccggaccggcctggacttcaacgagatgatcctcctgacgatgaagaacaaggcctggatggtgcaccgccagtggttcttcgacctgccgctcccctggaccagcggcgccaccaccgagacgcccacctggaaccggaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccgcctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccctgcaagatcccgttcagcaccgaggacgggcagggcaaggcccacaacggccggctgatcacggccaaccccgtcgtgaccaagaaggaggagcccgtgaacatcgaggccgagcccccgttcggggagagcaacatcgtcatcggcaccggggacaacgcgctgaagatcaactggtacaagaagggctccagcatcgggaagatgttcgaggccaccgcccgcggcgcccggcgcatggccatcctcggcgacacggcgtgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcggacatggggtgcgtcatcaactggaagggcaaggagctcaagtgcggcagcgggatcttcgtgaccaacgaggtgcacacctggaccgagcagtacaagttccaggccgactcccccaagcgcctggccacggccatcgccggcgcgtgggagaacggggtctgcggcatccggagcaccacccgcatggagaacctgctctggaagcagatcgccaacgagctgaactacatcctgtgggagaacaacatcaagctcaccgtggtggtcggggacatcatcggcgtgctgaagcagggcaagcggacgctgacgccccagcccatggagctcaagtactcctggaagacctgggggaaggccaagatcgtgaccgccgagacgcagaacagctccttcatcatcgacggcccgaacacccccgagtgccccagcgcgtcccgcgcctggaacgtctgggaggtggaggactacgggttcggcgtgttcaccaccaacatctggctgaagctgcgggaggtctacacccagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacgtgcacctggcccaagtcccacaccctgtggagcaacggcgtgctggagtccgacatgatcatccccaagtccctcgccgggcccatctcccagcacaaccaccgccccggctaccacacccagacggccgggccgtggcacctgggcaagctggagctcgacttcaactactgcgagggcaccaccgtggtcatcaccgagaactgcgggacgcggggccccagcctgcgcaccaccaccgtgtccgggaagctgatccacgagtggtgctgccggagctgcacgctgccgcccctccgctacatgggcgaggacgggtgctggtacggcatggagatccggccgatctccgagaaggaggagaacatggtcaagagcctggtgtccgccggcagcgggaaggtggacaacttcaccatgggcgtgctctgcctggcgatcctgttcgaggaggtcatgcgcgggaagttcggcaagaagcacatgatcgccggggtgttcttcaccttcgtgctcctgctgtccggccagatcacctggcgggacatggcccacacgctcatcatgatcggcagcaacgcctccgaccgcatggggatgggcgtcacctacctggccctgatcgcgaccttcaagatccagcccttcctcgccctggggttcttcctgcggaagctcaccagccgcgagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatgttcaccctgacggtggcctggcggaccgcgaccctcatcctggccggggtcagcctgctccccgtgtgccagtccagctccatgcgcaagaccgactggctgccgatggccgtcgccgccatgggcgtgccgcccctgcccctcttcatcttcaacctgaaggacacgctgaagcgccggagctggccgctcaacgagggggtgatggcggtcggcctggtgtccatcctggccagctccctcctgcgcaacgacgtgcccatggccggccccctggtcgccgggggcctcctgatcgcctgctacgtgatcaccgggaccagcgcggacctgaccgtggagaaggccgccgacatcacgtgggaggaggaggccgagcagaccggcgtctcccacaacctcatgatcaccgtggacgacgacgggaccatgcggatcaaggacgacgagaccgagaacatcctgacggtgctgctcaagaccgccctgctgatcgtcagcggcgtgttcccctactccatcccggcgaccctcctggtgtggcacacctggcagaagcagacgcagcgcagcggcgtcctgtgggacgtgcccagcccgcccgagacccagaaggccgagctcgaggagggggtgtaccggatcaagcagcagggcatcctggggaagacccaggtcggcgtgggggtgcagaaggagggcgtcttccacaccatgtggcacgtgacgcgcggcgccgtgctgacctacaacgggaagcggctcgagccgaactgggccagcgtcaagaaggacctgatctcctacggcgggggctggcgcctgagcgcgcagtggcagaagggggaggaggtccaggtgatcgccgtcgagcccggcaagaaccccaagaacttccagaccatgcccggcaccttccagacgaccaccggggagatcggcgccatcgccctggacttcaagccggggacctccggcagccccatcatcaaccgggagggcaaggtggtggggctctacggcaacggggtcgtgacgaagaacggcgggtacgtgagcggcatcgcccagaccaacgcggagcccgacggcccgacccccgagctggaggaggagatgttcaagaagcgcaacctgaccatcatggacctccaccccgggtccggcaagacgcggaagtacctgcccgccatcgtccgcgaggccatcaagcggcgcctgcggaccctcatcctggccccgacccgcgtggtggccgcggagatggaggaggccctgaaggggctccccatccggtaccagaccacggccaccaagagcgagcacaccggccgcgagatcatcgacctgatgtgccacgccaccttcacgatgcggctgctctcccccgtccgcgtgcccaactacaacctgatcatcatggacgaggcccacttcaccgacccggcgagcatcgccgcccgggggtacatctccacccgcgtgggcatgggcgaggccgcggccatcttcatgaccgccacgccgcccgggaccgccgacgccttcccccagagcaacgcgccgatccaggacgaggagcgcgacatccccgagcggtcctggaacagcggcaacgagtggatcaccgacttcgccgggaagaccgtctggttcgtgccctccatcaaggccggcaacgacatcgccaactgcctgcgcaagaacgggaagaaggtgatccagctcagccggaagacgttcgacaccgagtaccagaagaccaagctgaacgactgggacttcgtcgtgaccacggacatctccgagatgggcgccaacttcaaggcggaccgcgtgatcgacccccggcgctgcctgaagccggtcatcctcaccgacggccccgagcgggtgatcctggccgggcccatgcccgtgaccgccgccagcgccgcgcagcgccggggccgcgtcgggcggaacccgcagaaggagaacgaccagtacatcttcaccggccagcccctgaacaacgacgaggaccacgcccactggaccgaggccaagatgctcctggacaacatcaacacgcccgaggggatcatccccgccctgttcgagccggagcgcgagaagtccgcggccatcgacggcgagtaccggctcaagggcgagagccgcaagaccttcgtggagctgatgcggcgcggggacctgcccgtgtggctcgcccacaaggtcgcctccgagggcatcaagtacaccgaccggaagtggtgcttcgacgggcagcgcaacaaccagatcctggaggagaacatggacgtggagatctggaccaaggagggcgagaagaagaagctgcggccccgctggctcgacgcccgcacgtacagcgaccccctggcgctgaaggagttcaaggacttcgccgccggccggaagtccatcgccctcgacctggtcaccgagatcgggcgcgtgccgagccacctggcccaccggacccgcaacgcgctcgacaacctggtgatgctgcacacctccgagcacggcgggcgggcctaccgccacgccgtcgaggagctccccgagacgatggagaccctgctgctcctgggcctgatgatcctcctgaccgggggcgccatgctgttcctcatcagcggcaaggggatcggcaagaccagcatcgggctgatctgcgtgatcgcctccagcggcatgctgtggatggcggagatccccctccagtggatcgcctccgccatcgtgctggagttcttcatgatggtcctgctcatcccggagcccgagaagcagcggacgccccaggacaaccagctggcctacgtggtgatcgggatcctgaccctcgccgcgatcatcgccgccaacgagatgggcctgctggagaccaccaagcgcgacctcggcatgagcaaggagcccggggtcgtgtccccgacgagctacctggacgtggacctgcaccccgcctccgcgtggaccctctacgccgtcgccaccaccgtgatcacgcccatgctgcggcacaccatcgagaacagcaccgccaacgtgtccctggccgcgatcgccaaccaggccgtcgtgctcatgggcctggacaaggggtggcccatcagcaagatggacctgggcgtgccgctcctggccctggggtgctactcccaggtcaaccccctcaccctgacggccgcggtgctgctcctgatcacccactacgccatcatcggccccggcctgcaggccaaggccacccgcgaggcccagaagcggaccgcggccgggatcatgaagaaccccacggtggacggcatcatgaccatcgacctcgacccggtcatctacgacagcaagttcgagaagcagctgggccaggtgatgctgctcgtgctgtgcgccgtccagctgctcctgatgcgcacctcctgggccctgtgcgaggcgctcaccctggccacgggccccatcaccaccctgtgggagggcagccccgggaagttctggaacaccacgatcgccgtgtccatggccaacatcttccggggcagctacctcgccggggcgggcctggccttctccatcatgaagtccgtggggaccggcaagcgcggcaccgggtcccagggcgagaccctgggggagaagtggaagaagaagctcaaccagctgagccggaaggagttcgacctgtacaagaagtccggcatcaccgaggtcgaccgcacggaggccaaggaggggctcaagcggggcgagatcacccaccacgccgtgtcccgcggcagcgccaagctgcagtggttcgtggagcggaacatggtcatccccgaggggcgcgtgatcgacctgggctgcgggcggggcgggtggtcctactactgcgcgggcctcaagaaggtgaccgaggtccgcggctacaccaagggcgggccggggcacgaggagcccgtgcccatgacgacctacggctggaacatcgtgaagctgatgagcgggaaggacgtcttctacctgcccccggagaagtgcgacaccctgctctgcgacatcggcgagtccagcccctcccccaccgtggaggagagccgcacgatccgggtgctgaagatggtcgagccctggctgaagaacaaccagttctgcatcaaggtgctcaacccgtacatgcccaccgtgatcgagcacctggagcgcctgcagcggaagcacggcgggatgctcgtccgcaaccccctgtcccggaacagcacccacgagatgtactggatctccaacggcaccgggaacatcgtggccagcgtgaacatggtctcccgcctgctcctgaaccggttcacgatgacccaccgccggcccaccatcgagaaggacgtggacctgggcgccggcacccgccacgtgaacgccgagccggagacgcccaacatggacgtcatcggggagcggatcaagcgcatcaaggaggagcacaacagcacctggcactacgacgacgagaacccctacaagacctgggcctaccacggctcctacgaggtgaaggcgaccgggagcgcctccagcatgatcaacggcgtggtcaagctcctgacgaagccgtgggacgtggtccccatggtgacccagatggccatgaccgacaccacgcccttcgggcagcagcgggtgttcaaggagaaggtcgacacccgcacgccccggtccatgccgggcacccgccgggtgatgggcatcaccgccgagtggctgtggcgcaccctcgggcggaacaagaagccccgcctgtgcacccgcgaggagttcaccaagaaggtgcggacgaacgcggccatgggcgccgtcttcaccgaggagaaccagtgggacagcgccaaggccgcggtggaggacgaggacttctggaagctggtggaccgcgagcgggagctccacaagctggggaagtgcggcagctgcgtctacaacatgatggggaagcgcgagaagaagctgggcgagttcggcaaggccaaggggtcccgggccatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgcgatgtacgccgacgacaccgccgggtgggacacccggatcacggaggacgacctgcacaacgaggagaagatcacccagcagatggaccccgagcaccgccagctggccaacgccatcttcaagctcacctaccagaacaaggtggtcaaggtgcagcggccgacccccaccggcacggtgatggacatcatcagccgcaaggaccagcggggctccgggcaggtcggcacctacgggctgaacaccttcaccaacatggaggcgcagctgatccgccagatggagggcgagggggtgctcagcaaggccgacctggagaacccccacctccccgagaagaagatcacgcagtggctcgagaccaagggcgtggagcggctgaagcgcatggccatctccggcgacgactgcgtcgtgaagccgatcgacgaccggttcgccaacgccctgctcgcgctgaacgacatggggaaggtgcgcaaggacatcccccagtggcagcccagcaagggctggcacgactggcagcaggtccccttctgctcccaccacttccacgagctgatcatgaaggacgggcggaagctcgtggtgccgtgccgcccccaggacgagctgatcggccgggcccgcatcagccaggggtccggctggagcctgcgcgagaccgcctgcctcggcaaggcctacgcgcagatgtggtccctgatgtacttccaccggcgcgacctgcggctcgccagcaacgccatctgctccgccgtccccgtgcactgggtgcccaccagccgcacgacctggtccatccacgcccaccaccagtggatgaccaccgaggacatgctgacggtctggaaccgggtgtggatcgaggacaacccgtggatggaggacaagacccccgtgaccacctgggagaacgtcccctacctggggaagcgcgaggaccagtggtgcggcagcctcatcgggctgacgagccgggcgacctgggcccagaacatccccaccgccatccagcaggtccgctccctgatcggcaacgaggagttcctcgactacatgccgagcatgaagcggttccgcaaggaggaggagtccgagggggccatctggtga

SEQ ID NO: 9862 - RNA, 9873 nt, synthetic construct
  misc_feature 1..9873: note = derived and/or modified CDS sequence (opt1) from DENV-3__JF808119__SS-prME
  source 1..9873: mol_type = other RNA
accagcctgtgcctcatgatgatcctgcccaccgccctggccttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgcggagggcgcctggcgccaggtggagaaggtcgagacctgggccctgcgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcggtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggccatcctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgccccgtgcaagatccccttcagcacggaggacgggcagggcaaggcgcacaacggccgcctgatcaccgccaaccccgtcgtgaccaagaaggacgagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcaggtcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcatgttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatgttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcgtgttcccgtacagcatccccgccaccctgctcgtctggcacacctggcagaagcagacccagcggtccggcgtgctgtgggacgtgcccagcccgcccgagacgcagaaggcggagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggcctccgtgaagaaggacctgatcagctacggcgggggctggcggctctccgcccagtggcagaagggggaggaggtgcaggtcatcgcggtggagcccggcaagaaccccaagaacttccagaccatgcccggcaccttccagaccacgaccggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagacgaacgccgagccggacggccccacccccgagctggaggaggagatgttcaagaagcggaacctcaccatcatggacctgcaccccgggagcggcaagacccgcaagtacctgccggcgatcgtgcgggaggccatcaagcgccggctccgcacgctgatcctggcccccacccgggtggtcgccgccgagatggaggaggcgctcaaggggctgcccatccgctaccagaccaccgccacgaagtccgagcacaccggccgggagatcgtggacctgatgtgccacgccaccttcaccatgcgcctcctgagccccgtgcgggtcccgaactacaacctgatcatcatggacgaggcccacttcacggaccccgcctccatcgcggcccgcgggtacatcagcacccgggtgggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaaggccgaccgggtgatcgacccgcgccggtgcctcaagcccgtgatcctgacggacggccccgagcgcgtcatcctggcggggcccatgccggtgaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtcgagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgcggccggccgcaagagcatcgccctggacctggtgacggagatcgggcgggtcccctcccacctcgcccaccgcacccggaacgccctggacaacctggtgatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgcgagcgccatcgtgctggagttcttcatgatggtgctcctgatccccgagcccgagaagcagcgcacgccccaggacaaccagctggcctacgtcgtgatcgggatcctcacgctggccgccatcatcgcggccaacgagatgggcctgctcgagaccaccaagcgggacctgggcatgtccaaggagccgggggtggtcagccccacctcctacctggacgtggacctccaccccgccagcgcctggacgctgtacgcggtggccaccaccgtcatcacccccatgctgcgccacacgatcgagaactccaccgccaacgtgagcctcgccgccatcgcgaaccaggccgtggtcctgatgggcctggacaaggggtggccgatctccaagatggacctcggcgtgcccctgctggccctcgggtgctacagccaggtgaaccccctgaccctgaccgccgccgtcctcctgctgatcacgcactacgcgatcatcggccccggcctccaggccaaggccacccgggaggcccagaagcgcaccgccgcggggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcggaccagctgggccctctgcgaggccctgaccctggcgaccggccccatcacgaccctctgggagggctcccccgggaagttctggaacaccaccatcgccgtcagcatggccaacatcttccgcggctcctacctggccggggccggcctggcgttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagacgacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcatcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaagatcctgaacccctacatgcccacggtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcaccatgacgcaccggcgcccgaccatcgagaaggacgtggacctcggcgccggcacccggcacgtgaacgccgagcccgagacccccaacatggacgtcatcggggagcgcatcaagcggatcaaggaggagcacaacagcacgtggcactacgacgacgagaacccgtacaagacctgggcctaccacggctcctacgaggtgaaggccaccgggagcgcgtccagcatgatcaacggcgtggtcaagctgctgaccaagccctgggacgtggtccccatggtgacgcagatggccatgaccgacaccacccccttcgggcagcagcgcgtgttcaaggagaaggtcgacacgcggaccccgcgcagcatgcccggcacccggcgcgtgatgggcatcaccgccgagtggctctggcggacgctggggcgcaacaagaagccccggctgtgcacccgcgaggagttcaccaagaaggtgcgcaccaacgccgcgatgggcgccgtcttcacggaggagaaccagtgggactccgccaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtggtcaaggtgcagcgccccacccccaccggcaccgtgatggacatcatcagccggaaggaccagcgcggctccgggcaggtcggcacgtacgggctgaacaccttcaccaacatggaggcccagctcatccggcagatggagggcgagggggtgctgagcaaggcggacctggagaacccccacctcccggagaagaagatcacccagtggctggagacgaagggcgtggagcgcctgaagcggatggccatctccggcgaggactgcgtcctcaagcccatcgacgaccgcttcgacaacgccctgctggccctcaacgacatggggaaggtgcggaaggacatcccccagtggcagcccagcaagggctggcacgactggcagcaggtcccgttctgctcccaccacttccacgagctgatcatgaaggacgggcgcaagctggtcgtgccctgccggccccaggacgagctcatcggccgcgcccggatcagccagggggcgggctggtccctgcgcgagaccgcctgcctgggcaaggcctacgcccagatgtggagcctcatgtacttccaccgccgggacctgcgcctggcgtccaacgccatctgcagcgccgtgcccgtccactgggtgccgacctcccggaccacgtggagcatccacgccctccaccagtggatgaccaccgaggacatgatcaccgtgtggaaccgcgtctggatcgaggacaacccctggatggaggacaagacgcccgtgaccacctgggaggacgtgccctacctggggaagcgggaggaccagtggtgcggcagcctgatcgggctcacctcccgcgccacgtgggcgcagaacatcccgaccgccatccagcaggtccggagcctgatcggcaacgaggagttcctggactacatgccctccatgaagcgcttccggaaggaggaggagagcgagggggccatctggtga

SEQ ID NO: 9863 - RNA, 9873 nt, synthetic construct
  misc_feature 1..9873: note = derived and/or modified CDS sequence (opt1) from DENV-3__JF808118__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgatcctccgcaagctgtgcatcgagggcaagatcacgaacatcaccaccgacagccggtgccccacccagggcgaggccgtgctgccggaggagcaggaccagaactacgtctgcaagcacacgtacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggccagcacgaccgaggcgatcctgcccgagtacggcaccctggggctcgagtgctccccgcggaccggcctggacttcaacgagatgatcctgctcaccatgaagaacaaggcctggatggtgcaccgccagtggttcttcgacctgcccctgccctggacgagcggcgccaccaccgagacccccacgtggaaccggaaggagctcctggtgaccttcaagaacgcccacgccaagaagcaggaggtcgtggtgctggggtcccaggagggcgcgatgcacaccgccctcaccggggccacggagatccagaacagcggcgggacctccatcttcgccggccacctgaagtgccgcctgaagatggacaagctcgagctgaagggcatgagctacgccatgtgcaccaacaccttcgtcctgaagaaggaggtgtccgagacgcagcacgggaccatcctcatcaaggtggagtacaagggcgaggacgcgccgtgcaagatccccttcagcaccgaggacgggcagggcaaggcccacaacggccggctgatcaccgccaaccccgtcgtgacgaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacgtggaccgagcagtacaagttccaggccgactcccccaagcgcctcgccaccgccatcgccggcgcgtgggagaacggggtctgcggcatccggagcaccacgcgcatggagaacctgctgtggaagcagatcgccaacgagctcaactacatcctgtgggagaacaacatcaagctgaccgtggtggtcggggacatcatcggcgtgctcgagcagggcaagcggaccctgacgccccagccgatggagctgaagtactcctggaagacgtgggggaaggccaagatcgtgaccgccgagacccagaacagctccttcatcatcgacggccccaacacccccgagtgccccagcgcgtcccgcgcctggaacgtctgggaggtggaggactacgggttcggcgtgttcacgaccaacatctggctcaagctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccgcccgggctaccacacccagaccgccgggccctggcacctcggcaagctggagctggacttcaactactgcgagggcaccacggtggtcatcaccgagaactgcgggacccggggccccagcctccgcaccacgaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcacgttcgtgctgctcctgtccggccagatcacctggcgggacatggcccacaccctgatcatgatcggcagcaacgcctccgaccgcatggggatgggcgtcacctacctcgccctgatcgcgacgttcaagatccagcccttcctggccctcgggttcttcctgcggaagctgaccagccgcgagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatgttcaccctgaccgtggcctggcggaccgcgacgctgatcctcgccggggtcagcctgctgccggtgtgccagtccagctccatgcgcaagaccgactggctccccatggccgtcgccgccatgggcgtgccgcccctcccgctgttcatcttcagcctcaaggacaccctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacgtccgcggacctgaccgtggagaaggccgccgacatcacctgggaggaggaggccgagcagaccggcgtcagccacaacctgatgatcacggtggacgacgacgggaccatgcggatcaaggacgacgagaccgagaacatcctcaccgtgctgctgaagaccgccctcctgatcgtctccggcgtgttcccgtacagcatccccgcgacgctgctcgtgtggcacacctggcagaagcagacccagcgctccggcgtcctgtgggacgtgcccagcccgcccgagacccagaaggccgagctggaggagggggtgtaccggatcaagcagcagggcatcttcgggaagacgcaggtcggcgtgggggtgcagaaggagggcgtcttccacaccatgtggcacgtgacccgcggcgccgtgctcacctacaacgggaagcggctggagcccaactgggcctccgtcaagaaggacctgatcagctacggcgggggctggcgcctctccgcgcagtggcagaagggggaggaggtccaggtgatcgccgtcgagcccggcaagaaccccaagaacttccagacgatgcccggcaccttccagaccaccacgggggagatcggcgccatcgccctggacttcaagcccgggaccagcggcagccccatcatcaaccgggagggcaaggtggtggggctgtacggcaacggggtcgtgaccaagaacggcgggtacgtgtccggcatcgcccagaccaacgcggagccggacggccccacgcccgagctggaggaggagatgttcaagaagcgcaacctcaccatcatggacctgcaccccgggagcggcaagacccggaagtacctgccggccatcgtccgcgaggccatcaagcggcgcctccggaccctgatcctggcccccacgcgcgtggtggccgcggagatggaggaggccctcaaggggctgcccatccggtaccagaccaccgccaccaagtccgagcacacgggccgcgagatcgtcgacctgatgtgccacgccaccttcaccatgcggctcctgagccccgtgcgcgtgccgaactacaacctgatcatcatggacgaggcccacttcaccgaccccgcgtccatcgccgcccgggggtacatcagcacgcgcgtcggcatgggcgaggccgcggccatcttcatgaccgccacgccgcccgggaccgccgacgccttcccgcagtccaacgcgcccatccaggacgaggagcgcgacatccccgagcggagctggaactccggcaacgagtggatcacggacttcgccgggaagaccgtgtggttcgtgcccagcatcaaggccggcaacgacatcgccaactgcctccgcaagaacgggaagaaggtcatccagctgtcccggaagaccttcgacaccgagtaccagaagacgaagctgaacgactgggacttcgtggtgaccaccgacatcagcgagatgggcgccaacttcaaggcggaccgcgtcatcgacccgcggcgctgcctcaagcccgtgatcctgaccgacggccccgagcgggtgatcctggccgggcccatgccggtcacggccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacacggaccggaagtggtgcttcgacgggcagcgcaacaaccagatcctggaggagaacatggacgtcgagatctggaccaaggagggcgagaagaagaagctccggccccgctggctggacgcccgcacctactccgacccgctggcgctcaaggagttcaaggacttcgccgccggccgcaagagcatcgccctggacctggtgaccgagatcgggcgcgtgccctcccacctcgcccaccggacgcgcaacgcgctggacaacctggtcatgctccacaccagcgagcacggcgggcgggcctaccgccacgccgtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcaccctggccgcgatcatcgccgccaacgagatgggcctgctcgagacgaccaagcgcgacctgggcatgtccaaggagccgggggtggtgagccccacctcctacctggacgtcgacctccaccccgccagcgcgtggaccctgtacgccgtggccacgaccgtgatcacccccatgctgcggcacaccatcgagaactccacggccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacccactacgccatcatcggccccggcctccaggccaaggccacgcgcgaggcccagaagcggaccgcggccgggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcgcacgagctgggccctctgcgaggcgctgaccctggccaccggccccatcaccacgctctgggagggctcccccgggaagttctggaacaccaccatcgccgtgagcatggccaacatcttccggggctcctacctggccggggcgggcctggccttcagcatcatgaagtccgtcgggaccggcaagcgcggcacggggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagaccacgcaccacgccgtgagccgcggctccgccaagctgcagtggttcgtcgagcggaacatggtgatcccggaggggcgcgtgatcgacctcggctgcgggcggggcgggtggagctactactgcgcgggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgccgagtggctctggcgcaccctggggcggaacaagaagccccgcctgtgcacgcgcgaggagttcaccaagaaggtccggaccaacgcggccatgggcgccgtgttcaccgaggagaaccagtgggactccgccaaggccgcggtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgcgatgtacgccgacgacacggccgggtgggacacccggatcaccgaggacgacctgcacaacgaggagaagatcacccagcagatggacccggagcaccgccagctcgccaacgccatcttcaagctgacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcgcagctcatccgccagatggagggcgagggggtgctgagcaaggccgacctggagaacccccacctcccggagaagaagatcacccagtggctggagaccaagggcgtcgagcggctgaagcgcatggccatctccggcgacgactgcgtggtgaagcccatcgacgaccggttcgccaacgccctcctggcgctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctccgcgagacggcctgcctgggcaaggcgtacgcccagatgtggagcctgatgtacttccaccggcgcgacctccggctggcctccaacgccatctgcagcgccgtgcccgtgcactgggtcccgacctcccgcaccacctggagcatccacgcgcaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggccacctgggcccagaacatcccgacggccatccagcaggtccgcagcctcatcggcaacgaggagttcctggactacatgccctccatgaagcggttccgcaaggaggaggagagcgagggggccatctggtga

SEQ ID NO: 9864 - RNA, 9873 nt, synthetic construct
  misc_feature 1..9873: note = derived and/or modified CDS sequence (opt1) from DENV-3__JF808127__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcggcggcgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcctgaccatgcgctgcgtgggggtgggcaaccgggacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcgcaagctgtgcatcgagggcaagatcaccaacatcaccaccgacagccggtgccccacgcagggcgaggccgtgctcccggaggagcaggaccagaactacgtctgcaagcacacctacgtggaccgcgggtggggcaacgggtgcggcctgttcgggaagggctccctggtgacctgcgccaagttccagtgcctcgagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctgcccgagtacggcaccctcgggctggagtgctccccgcggaccggcctggacttcaacgagatgatcctcctgacgatgaagaacaaggcctggatggtgcaccgccagtggttcttcgacctgcccctcccctggaccagcggcgccaccaccgagacgcccacctggaaccggaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccgcctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagagcaacatcgtcatcggcaccggggacaacgcgctgaagatcaactggtacaagaagggctccagcatcgggaagatgttcgaggccaccgcccgcggcgcccggcgcatggccatcctcggcgacacggcgtgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcggacatggggtgcgtcatcaactggaagggcaaggagctcaagtgcggcagcgggatcttcgtgaccaacgaggtgcacacctggaccgagcagtacaagttccaggccgactcccccaagcgcctggccacggccatcgccggcgcgtgggagaacggggtctgcggcatccggagcaccacccgcatggagaacctgctctggaagcagatcgccaacgagctgaactacatcctgtgggagaacaacatcaagctcaccgtggtggtcggggacatcatcggcgtgctggagcagggcaagcggacgctgacgccccagccgatggagctcaagtactcctggaagacctgggggaaggccaagatcgtgaccgccgagacgcagaacagctccttcatcatcgacggccccaacacccccgagtgccccagcgcgtcccgcgcctggaacgtctgggaggtggaggactacgggttcggcgtgttcaccaccaacatctggctgaagctgcgggaggtctacacccagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacgtgcacctggccgaagtcccacaccctgtggagcaacggcgtgctggagtccgacatgatcatccccaagagcctcgccgggcccatctcccagcacaaccaccgcccgggctaccacacccagacggccgggccctggcacctgggcaagctggagctcgacttcaactactgcgagggcaccaccgtggtcatcaccgagaactgcgggacgcggggccccagcctgcgcaccaccaccgtgtccgggaagctgatccacgagtggtgctgccggagctgcacgctgccgcccctgcgctacatgggcgaggacgggtgctggtacggcatggagatccggcccatctccgagaaggaggagaacatggtcaagagcctggtctccgccggcagcgggaaggtggacaacttcaccatgggcgtgctctgcctggcgatcctgttcgaggaggtcatgcgcgggaagttcggcaagaagcacatgatcgccggggtgttcttcaccttcgtgctcctgctgtccggccagatcacctggcgggacatggcccacacgctcatcatgatcggcagcaacgcctccgaccgcatggggatgggcgtcacctacctggccctgatcgcgaccttcaagatccagcccttcctcgccctggggttcttcctgcggaagctcaccagccgcgagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatgttcaccctgacggtggcctggcggaccgcgaccctcatcctggccggggtcagcctgctccccgtgtgccagtccagctccatgcgcaagaccgactggctgcccatggccgtcgccgccatgggcgtgccgcccctccccctgttcatcttcagcctgaaggacacgctgaagcgccggtcctggcccctcaacgagggggtgatggcggtcggcctggtgagcatcctggcctccagcctcctgcgcaacgacgtgcccatggccggccccctggtcgccgggggcctcctgatcgcctgctacgtgatcaccgggacctccgcggacctgaccgtggagaaggccgccgacatcacgtgggaggaggaggccgagcagaccggcgtcagccacaacctcatgatcaccgtggacgacgacgggaccatgcggatcaaggacgacgagaccgagaacatcctgacggtgctgctcaagaccgccctgctgatcgtctccggcgtgttcccgtacagcatccccgcgaccctcctggtgtggcacacctggcagaagcagacgcagcgctccggcgtcctgtgggacgtgccctccccgcccgagacccagaaggccgagctcgaggagggggtgtaccggatcaagcagcagggcatcttcgggaagacccaggtcggcgtgggggtgcagaaggagggcgtcttccacaccatgtggcacgtgacgcgcggcgccgtgctgacctacaacgggaagcggctggagcccaactgggcctccgtcaagaaggacctcatcagctacggcgggggctggcgcctgtccgcgcagtggcagaagggggaggaggtccaggtgatcgccgtcgagcccggcaagaaccccaagaacttccagaccatgccgggcaccttccagacgaccaccggggagatcggcgccatcgccctggacttcaagcccgggaccagcggcagccccatcatcaaccgggagggcaaggtggtggggctgtacggcaacggggtcgtgacgaagaacggcgggtacgtgtccggcatcgcccagaccaacgcggagccggacggccccacccccgagctcgaggaggagatgttcaagaagcgcaacctgaccatcatggacctgcaccccgggagcggcaagacgcggaagtacctcccggccatcgtccgcgaggccatcaagcggcgcctgcggaccctgatcctcgcccccacccgcgtggtggccgcggagatggaggaggccctgaaggggctgcccatccggtaccagaccacggccaccaagtccgagcacaccggccgcgagatcgtcgacctcatgtgccacgccaccttcacgatgcggctgctgagccccgtgcgcgtgccgaactacaacctcatcatcatggacgaggcccacttcaccgaccccgcgtccatcgccgcccgggggtacatcagcacccgcgtcggcatgggcgaggccgcggccatcttcatgaccgccacgccgcccgggaccgccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctgtcccggaagacgttcgacaccgagtaccagaagaccaagctcaacgactgggacttcgtggtgaccacggacatcagcgagatgggcgccaacttcaaggcggaccgcgtcatcgacccgcggcgctgcctgaagcccgtgatcctgaccgacggccccgagcgggtgatcctcgccgagcccatgccggtcaccgccgcctccgccgcgcagcgccgggggcgcgtgggccggaacccccagaaggagaacgaccagtacatcttcaccgggcagcccctgaacaacgacgaggaccacgcccactggaccgaggccaagatgctgctcgacaacatcaacacgcccgagggcatcatcccggccctgttcgagcccgagcgcgagaagtccgcggccatcgacggggagtaccggctgaagggcgagtcccgcaagaccttcgtggagctcatgcggcgcggcgacctgcccgtctggctggcccacaaggtggccagcgaggggatcaagtacaccgaccggaagtggtgcttcgacggccagcgcaacaaccagatcctcgaggagaacatggacgtcgagatctggaccaaggagggggagaagaagaagctgcggccccgctggctggacgcccgcacgtactccgacccgctcgcgctgaaggagttcaaggacttcgccgccggccgcaagagcatcgccctggacctcgtgaccgagatcggccgcgtgccctcccacctggcccaccggacccgcaacgcgctggacaacctcgtcatgctgcacaccagcgagcacgggggccgggcctaccgccacgccgtggaggagctgcccgagacgatggagaccctcctgctgctcgggctgatgatcctgctcaccggcggggccatgctgttcctgatcagcggcaagggcatcgggaagacctccatcggcctcatctgcgtgatcgccagctccgggatgctgtggatggcggagatcccgctgcagtggatcgccagcgccatcgtcctcgagttcttcatgatggtgctgctgatccccgagcccgagaagcagcggacgccccaggacaaccagctcgcctacgtggtcatcggcatcctgaccctggccgcgatcatcgccgccaacgagatggggctcctggagaccaccaagcgcgacctgggcatgtccaaggagccgggcgtggtgagccccacgtcctacctcgacgtcgacctgcaccccgccagcgcgtggaccctgtacgccgtggccaccaccgtgatcacgcccatgctccggcacaccatcgagaactccaccgccaacgtcagcctggccgcgatcgccaaccaggccgtggtgctgatggggctcgacaagggctggccgatctccaagatggacctgggggtccccctgctcgccctgggctgctacagccaggtgaaccccctgaccctcacggccgcggtgctgctgctcatcacccactacgccatcatcgggcccggcctgcaggccaaggccacccgcgaggcccagaagcggaccgcggccggcatcatgaagaacccgacggtcgacgggatcatgaccatcgacctggaccccgtgatctacgactccaagttcgagaagcagctcggccaggtgatgctgctggtcctctgcgccgtgcagctgctgctcatgcgcaccagctgggccctgtgcgaggcgctgaccctcgccacggggcccatcaccaccctgtgggagggctcccccggcaagttctggaacaccacgatcgccgtgagcatggccaacatcttccgggggtcctacctggccggcgcggggctcgccttcagcatcatgaagtccgtcggcaccgggaagcgcggcaccggcagccagggggagaccctgggcgagaagtggaagaagaagctgaaccagctcagccggaaggagttcgacctgaacaagaagtccgggatcaccgaggtggaccgcacggaggccaaggagggcctgaagcgcggggagatcacccaccacgccgtgagccgcggctccgccaagctccagtggttcgtcgagcggaacatggtgatcccggagggccgcgtgatcgacctggggtgcggccgcgggggctggagctactactgcgcggggctgaagaaggtcaccgaggtgcgcggctacaccaagggcgggcccggccacgaggagcccgtgcccatgtccacgtacgggtggaacatcgtcaagctcatgagcggcaaggacgtgttctacctgccgcccgagaagtgcgacaccctgctgtgcgacatcggggagtccagcccctcccccaccgtggaggagagccgcaccatccgggtcctcaagatggtggagccgtggctgaagaacaaccagttctgcatcaaggtgctgaacccctacatgcccacggtcatcgagcacctcgagcgcctgcagcggaagcacggcggcatgctggtgcgcaaccccctctcccggaacagcacccacgagatgtactggatctccaacgggaccggcaacatcgtggccagcgtcaagatggtgtcccgcctgctgctcaaccggttcaccatgacgcaccgccggccgaccatcgagaaggacgtggacctgggggccggcacccgccacgtcaacgccgagcccgagacccccaacatggacgtgatcggcgagcggatcaagcgcatcaaggaggagcacaacagcacgtggcactacgacgacgagaacccgtacaagacctgggcctaccacgggtcctacgaggtgaaggcgaccggcagcgcctccagcatgatcaacggggtcgtgaagctgctcaccaagccctgggacgtcgtgcccatggtgacgcagatggccatgaccgacaccacccccttcggccagcagcgggtcttcaaggagaaggtggacacgcgcaccccgcggagcatgcccgggacccgccgggtgatgggcatcaccgccgagtggctgtggcgcacgctgggccggaacaagaagcccaagctctgcacccgcgaggagttcaccaagaaggtccgcaccaacgcggccatgggggccgtgttcacggaggagaaccagtgggactccgccaaggccgcggtggaggacgaggacttctggaagctggtcgaccgggagcgcgagctgcacaagctcggcaagtgcgggagctgcgtgtacaacatgatgggcaagcgggagaagaagctgggggagttcggcaaggccaagggctcccgcgccatctggtacatgtggctgggggcccggtacctcgagttcgaggccctgggcttcctgaacgaggaccactggttcagccgcgagaactcctacagcggggtggagggcgaggggctccacaagctgggctacatcctgcgggacatctccaagatccccggcggggcgatgtacgccgacgacaccgccggctgggacacccgcatcaccgaggacgacctccacaacgaggagaagatcacgcagcagatggacccggagcaccggcagctggccaacgccatcttcaagctgacctaccagaacaaggtcgtgaaggtgcagcgccccacccccaccgggaccgtcatggacatcatcagccggaaggaccagcgcggctccggccaggtggggacgtacggcctcaacaccttcaccaacatggaggcgcagctgatccggcagatggagggggagggcgtgctgagcaaggccgacctcgagaacccccacctcccggagaagaagatcacccagtggctggagacgaagggggtcgagcgcctcaagcggatggccatctccggcgacgactgcgtggtgaagcccatcgacgaccgcttcgccaacgccctgctggcgctcaacgacatgggcaaggtccggaaggacatcccccagtggcagcccagcaaggggtggcacgactggcagcaggtcccgttctgctcccaccacttccacgagctgatcatgaaggacggccgcaagctggtggtcccctgccggccccaggacgagctcatcgggcgcgcccggatcagccagggcgccgggtggtccctgcgcgagaccgcctgcctgggcaaggcgtacgcccagatgtggagcctcatgtacttccaccgccgggacctgcgcctggcctccaacgccatctgcagcgccgtgcccgtgcactgggtcccgacctcccggaccacgtggagcatccacgcgcaccaccagtggatgaccaccgaggacatgctcaccgtgtggaaccgcgtgtggatcgaggacaacccctggatggaggacaagacgcccgtcaccacctgggagaacgtgccctacctgggcaagcgggaggaccagtggtgcgggagcctgatcggcctcacctcccgcgccacgtgggcccagaacatcccgaccgccatccagcaggtccggagcctgatcgggaacgaggagttcctggactacatgccctccatgaagcgcttccggaaggaggaggagagcgagggcgccatctggtga

SEQ ID NO: 9865 - RNA, 9873 nt, synthetic construct
  misc_feature 1..9873: note = derived and/or modified CDS sequence (opt1) from DENV-3__JF808124__SS-prME
  source 1..9873: mol_type = other RNA
accagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcggcgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccttcgggctggagtgctccccgcggaccggcctcgacttcaacgagatgatcctgctgacgatgaagaacaaggcctggatggtgcaccgccagtggttcttcgacctccccctgccctggaccagcggcgccaccaccgagacgcccacctggaaccggaaggagctgctcgtgaccttcaagaacgcccacgccaagaagcaggaggtcgtggtgctggggtcccaggagggcgcgatgcacaccgccctgacgggggccaccgagatccagaacagcggcgggacctccatcttcgccggccacctcaagtgccgcctgaagatggacaagctggagctcaagggcatgagctacgccatgtgcaccaacacgttcgtcctgaagaaggaggtgtccgagacccagcacgggaccatcctgatcaaggtggagtacaagggcgaggacgcgccgtgcaagatccccttcagcaccgaggacgggcagggcaaggcccacaacggccggctcatcacggccaaccccgtcgtgaccaagaaggaggagctggtgaacatcgaggccgagcccccgttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccggagcacgacccgcatggagaacctgctgtggaagcaggtggccaacgagctcaactacatcctgtgggagaacaacatcaagctgaccgtggtcgtgggggacatcatcggcgtgctcgagcagggcaagcggaccctgacgccccagcccatggagctgaagtactcctggaagacctgggggaaggccaagatcgtcaccgccgagacccagaacagctccttcatcatcgacggcccgaacacgcccgagtgccccagcgcgtcccgcgcctggaacgtgtgggaggtggaggactacgggttcggcgtcttcaccaccaacatctggctcaagctgcgggaggtgtacacccagctgtgcgaccaccgcctcatgagcgccgccgtgaaggacgagcgggccgtccacgcggacatgggctactggatcgagagccagaagaacgggtcctggaagctggagaaggccagcctgatcgaggtgaagacctgcacgtggcccaagtcccacaccctctggagcaacggcgtgctggagtccgacatgatcatcccgaagagcctggccgggcccatctcccagcacaaccaccgccccggctaccacacccagaccgccgggccgtggcacctcggcaagctggagctggacttcaactactgcgagggcacgaccgtcgtgatcaccgagaactgcgggacccggggccccagcctccgcacgaccaccgtgtccgggaagctgatccacgagtggtgctgccggagctgcaccctgccccccctccgctacatgggcgaggacgggtgctggtacggcatggagatccggccgatctccgagaaggaggagaacatggtcaagagcctggtgtccgccggcagcgggaaggtggacaacttcacgatgggcgtcctgtgcctcgcgatcctgttcgaggaggtgatgcgcgggaagttcggcaagaagcacatgatcgccggggtgctgttcacctgcgtcctcctgctgtccggccagatcacctggcgggacatggcccacaccctcatcatgatcggcagcaacgcctccgaccgcatggggatgggcgtgacgtacctggccctgatcgcgaccttcaagatccagcccttcctcgccctggggttcttcctgcggaagctcaccagccgcgagaacctgctgctcggcgtgggcctggccatggccaccacgctgcagctccccgaggacatcgagcagatggggaacggcatcgcgctggggctgatggccctcaagctgatcacccagttcgagacctaccagctgtggaccgccctcatcagcctgacgtgctccaacaccatgttcaccctgaccgtcgcctggcggacggccaccctcatcctggcgggcgtgagcctgctccccgtctgccagtccagctccatgcgcaagaccgactggctgccgatggccgtggccgccatgggggtgccccccctgcccctcttcatcttcagcctgaaggacaccctgaagcgccggtcctggccgctcaacgagggcgtcatggccgtgggcctggtgagcatcctggcgtccagcctcctgcgcaacgacgtccccatggccgggcccctggtggccggcgggctcctgatcgcctgctacgtgatcacgggcacctccgccgacctgaccgtcgagaaggcggccgacatcacctgggaggaggaggccgagcagacgggggtgagccacaacctcatgatcaccgtggacgacgacggcaccatgcggatcaaggacgacgagaccgagaacatcctgaccgtcctgctcaagacggccctgctgatcctctccggcgtgttcccctacagcatcccggccaccctgctggtgtggcacacctggcagaagcagacccagcgctccggggtcctctgggacgtgcccagcccccccgagacgcagaaggcggagctggaggagggcgtgtaccggatcaagcagcaggggatcttcggcaagacccaggtcggggtgggcgtgcagaaggagggcgtcttccacaccatgtggcacgtgacccgcggggccgtgctgacgtacaacggcaagcggctcgagccgaactgggcctccgtcaagaaggacctgatcagctacgggggcgggtggcgcctgtccgcccagtggcagaagggcgaggaggtgcaggtgatcgcggtcgagcccggcaagaaccccaagaacttccagaccatgcccgggaccttccagaccacgaccggcgagatcggggccatcgccctggacttcaagccgggcaccagcggcagccccatcatcaaccgggaggggaaggtggtgggcctctacgggaacggcgtcgtgaccaagaacgggggctacgtgtccggcatcgcccagacgaacgccgagcccgacgggccgacccccgagctggaggaggagatgttcaagaagcgcaacctgaccatcatggacctccaccccggcagcgggaagacccggaagtacctgcccgcgatcgtccgcgaggccatcaagcggcgcctgcggacgctcatcctggccccgacccgcgtggtggccgccgagatggaggaggcgctgaagggcctccccatccggtaccagaccaccgccacgaagtccgagcacaccgggcgcgagatcgtcgacctgatgtgccacgccaccttcaccatgcggctgctcagccccgtgcgcgtgcccaactacaacctgatcatcatggacgaggcccacttcacggacccggcctccatcggcgcgcggggctacatcagcacccgcgtcgggatgggcgaggccgccgccatcttcatgaccgcgaccccccccgggacggccgacgccttcccccagtccaacgccccgatccaggacgaggagcgcgacatccccgagcggagctggaactccggcaacgagtggatcaccgacttcgccgggaagaccgtgtggttcgtgcccagcatcaaggcgggcaacgacatcgccaactgcctgcgcaagaacggcaagaaggtcatccagctctcccggaagaccttcgacacggagtaccagaagaccaagctgaacgactgggacttcgtggtgaccaccgacatcagcgagatgggggccaacttcaaggccgaccgcgtcatcgacccccggcgctgcctgaagccggtgatcctcacggacggccccgagcgggtgatcctggccgggcccatgcccgtcaccgcggcctccgccgcccagcgccggggccgcgtggggcggaacccgcagaaggagaacgaccagtacatcttcaccggccagcccctgaacaacgacgaggaccacgcccactggaccgaggcgaagatgctcctggacaacatcaacacccccgagggcatcatccccgccctgttcgagccggagcgcgagaagagcgccgccatcgacggggagtaccggctcaagggcgagtcccgcaagacgttcgtggagctgatgcggcgcggggacctgcccgtctggctcgcgcacaaggtggccagcgagggcatcatctacaccgaccggaagtggtgcttcgacggccagcgcaacaaccagatcctggaggagaacatggacgtcgagatctggaccaaggagggggagaagaagaagctgcggccccgctggctcgacgcccgcacctactccgaccccctggccctgaaggagttcaaggacttcgccgcgggccggaagagcatcgccctcgacctggtgacggagatcgggcgcgtgccgtcccacctggcccaccggacccgcaacgccctcgacaacctggtcatgctgcacaccagcgagcacggcgggcgggcctaccgccacgcggtggaggagctccccgagaccatggagacgctgctgctcctgggcctgatgatcctcctgaccggcggggccatgctgttcctcatcagcggcaaggggatcggcaagacctccatcgggctgatctgcgtgatcgccagctccggcatgagctggatggccgagatccccctgcagtggatcgcctccgcgatcgtcctcgagttcttcatgatggtgctgctgatcccggagcccgagaagcagcggaccccccaggacaaccagctcgcctacgtggtcatcggcatcctgacgctggccgccatcatcgccgcgaacgagatggggctcctggagaccaccaagcgcgacctgggcatgagcaaggagcccggggtggtgtccccgaccagctacctcgacgtcgacctgcaccccgcctccgcctggacgctgtacgccgtggcgaccaccgtgatcacccccatgctccggcacacgatcgagaacagcaccgccaacgtctccctggccgccatcgccaaccaggcggtggtgctgatgggcctcgacaaggggtggcccatcagcaagatggacctgggcgtcccgctgctcgccctgggctgctactcccaggtgaaccccctgaccctcaccgccgccgtgctgctgctcatcacgcactacgccatcatcgggcccggcctgcaggcgaaggccacccgcgaggcccagaagcggaccgccgccgggatcatgaagaaccccaccgtcgacggcatcatgacgatcgacctggacccggtgatctacgacagcaagttcgagaagcagctcggccaggtgatgctgctggtcctctgcgcggtgcagctgctgctcatgcgcacctcctgggccctgtgcgaggccctgaccctcgccaccgggcccatcacgaccctgtgggagggcagccccgggaagttctggaacaccaccatcgcggtgtccatggccaacatcttccggggcagctacctggccggggccggcctcgccttctccatcatgaagagcgtcggcacggggaagcgcggcaccgggagccagggcgagaccctgggggagaagtggaagaagaagctgaaccagctctcccggaaggagttcgacctgtacaagaagagcggcatcaccgaggtggaccgcaccgaggcgaaggagggcctgaagcggggggagatcacgcaccacgccgtgtcccgcggcagcgccaagctccagtggttcgtcgagcggaacatggtgatccccgaggggcgcgtgatcgacctgggctgcgggcggggcggctggtcctactactgcgccgggctgaagaaggtcaccgaggtgcgcggctacaccaaggggggcccggggcacgaggagcccgtgcccatgagcacctacggctggaacatcgtcaagctcatgtccggcaaggacgtgttctacctgcccccggagaagtgcgacacgctgctgtgcgacatcggggagagctcccccagccccaccgtggaggagtcccgcaccatccgggtcctcaagatggtggagccctggctgaagaacaaccagttctgcatcaaggtgctgaacccgtacatgcccaccgtcatcgagcacctcgagcgcctgcagcggaagcacggcgggatgctggtgcgcaaccccctcagccggaactccacgcacgagatgtactggatcagcaacggcaccggcaacatcgtggcctccgtcaacatggtgagccgcctgctgctcaaccggttcaccatgacccaccgccggcccacgatcgagaaggacgtggacctgggggcgggcacccgccacgtcaacgccgagccggagacccccaacatggacgtgatcggggagcggatcaagcgcatcaaggaggagcacaactccacctggcactacgacgacgagaacccctacaagacgtgggcctaccacggcagctacgaggtgaaggccaccgggtccgccagcagcatgatcaacggcgtcgtgaagctgctcaccaagccgtgggacgtcgtgcccatggtgacccagatggcgatgacggacaccacccccttcggccagcagcgggtcttcaaggagaaggtggacacccgcacgccccggtccatgccggggacccgccgggtgatgggcatcaccgccgagtggctgtggcgcaccctggggcggaacaagaagccccgcctctgcacgcgcgaggagttcaccaagaaggtccggaccaacgccgccatgggcgcggtgttcaccgaggagaaccagtgggacagcgccaaggccgccgtggaggacgaggacttctggaagctggtcgaccgcgagcgggagctgcacaagctcgggaagtgcggctcctgcgtgtacaacatgatgggcaagcgcgagaagaagctgggggagttcggcaaggccaaggggagccgggcgatctggtacatgtggctgggcgcccgctacctcgagttcgaggccctggggttcctgaacgaggaccactggttctcccgggagaacagctactccggcgtggagggcgaggggctccacaagctgggctacatcctgcgcgacatcagcaagatccccgggggcgccatgtacgccgacgacacggcgggctgggacacccggatcaccgaggacgacctccacaacgaggagaagatcacccagcagatggaccccgagcaccgccagctggccaacgccatcttcaagctgacgtaccagaacaaggtcgtgaaggtgcagcggccgacccccaccgggaccgtcatggacatcatctcccgcaaggaccagcggggcagcgggcaggtgggcacctacgggctcaacacgttcaccaacatggaggcccagctgatccgccagatggagggcgagggcgtgctgtccaaggccgacctcgagaacccccacctgcccgagaagaagatcacccagtggctggagaccaagggggtcgagcggctcaagcgcatggcgatcagcggcgacgactgcgtggtgaagccgatcgacgaccggttcgccaacgccctgctggccctcaacgacatggggaaggtccgcaaggacatcccccagtggcagccctccaagggctggcacgactggcagcaggtgcccttctgcagccaccacttccacgagctgatcatgaaggacgggcggaagctggtggtcccgtgccgcccccaggacgagctcatcggccgggcccgcatctcccagggcgcggggtggagcctgcgcgagacggcctgcctgggcaaggcctacgcccagatgtggtccctcatgtacttccaccggcgcgacctgcggctggcgagcaacgccatctgctccgccgtgcccgtgcactgggtccccaccagccgcaccacctggagcatccacgcccaccaccagtggatgacgaccgaggacatgctcaccgtgtggaaccgggtgtggatcgaggacaacccgtggatggaggacaagacccccgtcacgacctgggagaacgtgccctacctggggaagcgcgaggaccagtggtgcggctccctgatcgggctcaccagccgggccacctgggcgcagaacatccccacggccatccagcaggtgcgctccctgatcggcaacgaggagttcctggactacatgccgagcatgaagcggttccgcaaggaggaggagtccgagggcgccatctggtga

SEQ ID NO: 9866 - RNA, 9873 nt, synthetic construct
  misc_feature 1..9873: note = derived and/or modified CDS sequence (opt1) from DENV-3__JF808126__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgggacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcacgctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccgcaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcctggacctgcccctcccctggaccagcggcgccaccacggagacccccacctggaaccgcaaggagctgctggtgaccttcaagaacgcccacgccaagaagcaggaggtcgtggtgctcgggtcccaggagggcgcgatgcacacggccctgaccggggccaccgagatccagaacagcggcgggacctccatcttcgccggccacctgaagtgccggctcaagatggacaagctggagctgaagggcatgagctacgccatgtgcacgaacaccttcgtcctcaagaaggaggtgtccgagacccagcacgggaccatcctgatcaaggtggagtacaagggcgaggacgcgccgtgcaagatccccttcagcacggaggacgggcagggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctcggcgacacggcgtgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcggacatggggtgcgtcatcaactggaagggcaaggagctcaagtgcggcagcgggatcttcgtgaccaacgaggtgcacacctggaccgagcagtacaagttccaggccgactcccccaagcgcctggccacggccatcgccggcgcgtgggagaacggggtctgcggcatccgcagcaccacccggatggagaacctgctctggaagcagatcgccaacgagctgaactacatcctgtgggagaacaacatcaagctcaccgtggtggtcggggacatcatcggcgtgctggagcagggcaagcgcacgctgacgccccagccgatggagctcaagtactcctggaagacctggggcaagagcaagatcgtgaccgccgagacgcagaactccagcttcatcatcgacggccccaacacccccgagtgcccctccgccagccgggcgtggaacgtctgggaggtggaggactacgggttcggcgtgttcaccaccaacatctggctgaagctgcgcgaggtctacacccagctctgcgaccaccggctgatgagcgccgccgtgaaggacgagcgcgccgtgcacgccgacatgggctactggatcgagtcccagaagaacgggagctggaagctggagaaggcgtccctcatcgaggtcaagacgtgcacctggcccaagagccacaccctgtggtccaacggcgtgctggagagcgacatgatcatccccaagtccctcgccgggcccatcagccagcacaaccaccggccgggctaccacacccagacggccgggccctggcacctgggcaagctggagctcgacttcaactactgcgagggcaccaccgtggtcatcaccgagaactgcgggacgcgcggccccgccctgcggaccaccaccgtgtccgggaagctgatccacgagtggtgctgccgcagctgcacgctgccgcccctgcggtacatgggcgaggacgggtgctggtacggcatggagatccgccccatctccgagaaggaggagaacatggtcaagagcctggtctccgccggcagcgggaaggtggacaacttcaccatgggcgtgctctgcctggcgatcctgttcgaggaggtcatgcgggggaagttcggcaagaagcacatgatcgccggggtgttcttcaccttcgtgctcctgctgtccggccagatcacctggcgcgacatggcccacacgctcatcatgatcggcagcaacgcctccgaccggatggggatgggcgtcacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatgttcaccctgacggtggcctggcgcaccgcgaccctcatcctggccggggtcagcctgctccccgtgtgccagtccagctccatgcggaagaccgactggctgcccatggccgtcgccgccatgggcgtgccgcccctccccctgttcatcttcagcctgaaggacacgctgaagcgccgctcctgccccctcaacgagggggtgatggcggtcggcctggtgagcatcctggcctccagcctcctgcggaacgacgtgcccatggccggccccctggtcgccgggggcctcctgatcgcctgctacgtgatcaccgggacctccgcggacctgaccgtggagaaggccgccgacatcacgtgggaggaggaggccgagcagaccggcgtcagccacaacctcatgatcaccgtggacgacgacgggaccatgcgcatcaaggacgacgagaccgagaacatcctgacggtgctgctcaagaccgccctgctgatcgtctccggcgtgttcccgtacagcatccccgcgaccctcctggtgtggcacacctggcagaagcagacgcagcggtccggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacctacaacgggaagcgcctggagcccaactgggcctccgtcaagaaggacctcgtgagctacggcgggggctggcggctgtccgcgcagtggcagaagggggaggaggtgcaggtcatcgccgtggagcccggcaagaaccccaagaacttccagaccatgccgggcaccttccagacgaccaccggggagatcggcgccatcgccctggacttcaagcccgggaccagcggcagccccatcatcaaccgcgagggcaaggtggtcgggctgtacggcaacggggtggtgacgaagaacggcgggtacgtctccggcatcgcccagaccaacgcggagccggacggccccacccccgagctcgaggaggagatgttcaagaagcggaacctgaccatcatggacctgcaccccgggagcggcaagacgcgcaagtacctcccggccatcgtgcgggaggccatcaagcgccggctgcgcaccctgatcctcgcccccacccgggtggtcgccgcggagatggaggaggccctgaaggggctgcccatccgctaccagaccacggccaccaagtccgagcacaccggccgggagatcgtggacctcatgtgccacgccaccttcacgatgcgcctgctgagccccgtgcgggtccagaactacaacctcatcatcatggacgaggcccacttcaccgacccggcgtccatcgccgcccgcgggtacatcagcacccgggtgggcatgggcgaggccgcggccatcttcatgaccgccacgccgcccgggaccgccgacgccttcccccagtccaacgcgccgatccaggacgaggagcgcgacatccccgagcgcagctggaactccggcaacgagtggatcaccgacttcgccgggaagaccgtgtggttcgtccccagcatcaaggccggcaacgacatcgccaactgcctgcggaagaacgggaagaaggtgatccagctgtcccgcaagacgttcgacaccgagtaccagaagaccaagctcaacgactgggacttcgtggtcaccacggacatcagcgagatgggcgccaacttcaaggcggaccgggtgatcgacccccgccggtgcctgaagccggtgatcctgaccgacggccccgagcgcgtcatcctcgccgggcccatgcccgtgaccgccgcctccgccgcgcagcggcgcggccgggtggggcgcaacccgcagaaggagaacgaccagtacatcttcaccggccagcccctgaacaacgacgaggaccacgcccactggaccgaggccaagatgctgctcgacaacatcaacacgcccgaggggatcatccccgccctgttcgagccggagcgggagaagtccgcggccatcgacggcgagtaccgcctgaagggcgagtcccggaagaccttcgtcgagctcatgcgccgcggggacctgcccgtgtggctggcccacaaggtcgccagcgagggcatcaagtacaccgaccgccggtggtgcttcgacgggcagcgcaacaaccagatcctcgaggagaacatggacgtggagatctggaccaaggagggcgagaagaagaagctgcggccccgctggctggacgcccgcacgtactccgaccccctcgcgctgaaggagttcaaggacttcgccgccggccgcaagagcatcgccctggacctcgtgaccgagatcgggcgcgtcccgtcccacctggcccaccggacccgcaacgcgctggacaacctcgtgatgctgcacaccagcgagcacggcgggcgggcctaccgccacgccgtggaggagctgcccgagacgatggagaccctcctgctgctcggcctgatgatcctgctcaccgggggcgccatgctgttcctgatcagcggcaaggggatcggcaagacctccatcgggctcatctgcgtcatcgccagctccggcatgctgtggatggcggagatccccctgccgtggatcgccagcgccatcgtgctcgagttcttcatgatggtgctgctgatccccgagcccgagaagcagcggacgccccaggacaaccagctcgcctacgtcgtgatcgggatcctgaccctggccgcgatcatcgccgccaacgagatgggcctcctggagaccaccaagcgcgacctgggcatgtccaaggagccgggggtggtcagccccacgtcctacctcgacgtggacctgcaccccgccagcgcgtggaccctgtacgccgtggccaccaccgtcatcacgcccatgctccggcacaccatcgagaactccaccgccaacgtgagcctggccgcgatcgccaaccaggccgtggtcctgatgggcctcgacaaggggtggccgatctccaagatggacctgggcgtgcccctgctcgccctggggtgctacagccaggtgaaccccctgaccctcacggccgcggtcctgctgctcatcacccactacgccatcatcggccccggcctgcaggccaaggccacccgcgaggcccagaagcggaccgcggccgggatcatgaagaacccgacggtggacggcatcatgaccatcgacctggaccccgtgatctacgactccaagttcgagaagcagctcgggcaggtcatgctgctggtgctctgcgccgtgcagctgctgctcatgcgcaccagctgggccctgtgcgaggcgctgaccctcgccacgggccccatcaccaccctgtgggagggctcccccgggaagttctggaacaccacgatcgccgtcagcatggccaacatcttccggggctcctacctggccggggcgggcctcgccttcagcatcatgaagtccgtggggaccggcaagcgcggcaccgggagccagggcgagaccctgggggagaagtggaagaagaagctgaaccagctcagccggaaggagttcgacctgtacaagaagtccggcatcaccgaggtggaccgcacggaggccaaggaggggctgaagcggggcgagatcacccaccacgccgtcagccgcggctccgccaagctccagtggttcgtggagcggaacatggtgatcccggaggggcgcgtcatcgacctgggctgcgggcggggcgggtggagctactactgcgcgggcctgaagaaggtgaccgaggtgcgcggctacaccaagggcgggcccgggcacgaggagcccgtccccatgtccacgtacggctggaacatcgtgaagctcatgagcgggaaggacgtgttctacctgccgcccgagaagtgcgacaccctgctgtgcgacatcggcgagtccagcccctcccccaccgtcgaggagagccgcaccatccgggtgctcaagatggtggagccgtggctgaagaacaaccagttctgcatcaaggtcctgaacccctacatgcccacggtgatcgagcacctcgagcgcctgcagcggaagcacggcgggatgctggtgcgcaaccccctctcccggaacagcacccacgagatgtactggatctccaacggcaccgggaacatcgtcgccagcgtgaacatggtgtcccgcctgctgctcaaccggttcaccatgacgcaccgccggccgaccatcgagaaggacgtcgacctgggcgccggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggcgaccgggagcgcctccagcatgatcaacggcgtggtcaagctgctcaccaagccctgggacgtggtgcccatggtcacgcagatggccatgaccgacaccacccccttcgggcagcagcgggtgttcaaggagaaggtggacacgcgcaccccgcggagcatgcccggcacccgccgggtcatgggcatcaccgccgagtggctgtggcgcacgctggggcggaacaagaagccccgcctctgcacccgcgaggagttcaccaagaaggtgcggaccaacgcggccatgggcgccgtgttcacggaggagaaccagtgggactccgccaaggccgcggtcgaggacgaggacttctggaagctggtggaccgcgagcgggagctgcacaagctcgggaagtgcggcagctgcgtgtacaacatgatggggaagcgcgagaagaagctgggcgagttcggcaaggccaaggggtcccgggccatctggtacatgtggctgggcgcccgctacctcgagttcgaggccctggggttcctgaacgaggaccactggttcagccgggagaactcctacagcggcgtcgagggggagggcctccacaagctgggctacatcctgcgcgacatctccaagatccccgggggcgcgatgtacgccgacgacaccgccgggtgggacacccggatcaccgaggacgacctccacaacgaggagaagatcacgcagcagatggacccggagcaccgccagctggccaacgccatcttcaagctgacctaccagaacaaggtggtgaaggtccagcggcccacccccaccggcaccgtgatggacatcatcagccgcaaggaccagcggggctccggccaggtgggcacgtacgggctcaacaccttcaccaacatggaggcgcagctgatccgccagatggagggcgagggggtcctgagcaaggccgacctcgagaacccccacctcccggagaagaagatcacccagtggctggagacgaagggcgtggagcggctcaagcgcatggccatctccggcgacgactgcgtggtcaagcccatcgacgaccggttcgccaacgccctgctggcgctcaacgacatggggaaggtgcgcaaggacatcccccagtggcagcccagcaagggctggcacgactggcagcaggtcccgttctgctcccaccacttccacgagctgatcatgaaggacgggcggaagctggtcgtgccctgccgcccccaggacgagctcatcggccgggcccgcatcagccagggggccggctggtccctgcgcgagaccgcctgcctgggcaaggcgtacgcccagatgtggagcctcatgtacttccaccggcgcgacctgcggctggcctccaacgccatctgcagcgccgtgcccgtccactgggtgccgacctcccgcaccacgtggagcatccacgcgcaccaccagtggatgaccaccgaggacatgctcaccgtgtggaaccgggtctggatcgaggacaacccctggatggaggacaagacgcccgtgaccacctgggagaacgtgccctacctggggaagcgcgaggaccagtggtgcggcagcctgatcgggctcacctcccgggccacgtgggcccagaacatcccgaccgccatccagcaggtccgcagcctgatcggcaacgaggagttcctggactacatgccctccatgaagcggttccgcaaggaggaggagagcgagggggccatctggtga

SEQ ID NO: 9867 - RNA, 9873 nt, synthetic construct
  misc_feature 1..9873: note = derived and/or modified CDS sequence (opt1) from DENV-3__JF808125__SS-prME
  source 1..9873: mol_type = other RNA
accagcctctgcctcatgatgatcctgcccgcggccctggcgttccacctcaccagccgcgacggcgagccccggatgatcgtgggggagaacgagcggggcaagagcctgctgttcaagaccgccagcgggatcaaccggcgcaccctcatcgccatggacctgggcgagatgtgcgaggagaccgagacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtcggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtcgtgatcttcatcctgctgatgctcgtgacgcccagcatgaccatgcgctgcgtcggggtgggcaaccgggacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtccaccgccagtggttcttcgacctgcccctgccctggaccagcggcgccaccgccgagacccccacgtggaaccggaaggagctcctggtgaccttcaagaacgcccacgcgaagaagcaggaggtggtcgtgctggggtcccaggagggcgccatgcacaccgccctcaccggggccacggagatccagaacagcggcgggacctccatcttcgccggccacctgaagtgccgcctgaagatggacaagctcgagctgaagggcatgagctacgcgatgtgcaccaacaccttcgtgctgaagaaggaggtctccgagacgcagcacgggaccatcctcatcaaggtggagtacaagggcgaggacgccccgtgcaagatccccttcagcaccgaggacgggcagggcaaggcccacaacggccggctgatcaccgccaaccccgtggtcacgaagaaggaggagcccgtgaacatcgaggcggagccgcccttcggggagagcaacatcgtgatcggcatcggggacaacgccctgaagatcaactggtacaagaagggctccagcatcgggaagatgttcgaggccaccgcccgcggcgcccgccggatggcgatcctgggcgacaccgcctgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacgtggatcggcctgaacagcaagaacacctccatgagcttctcctgcatcgccatcgggatcatcaccctctacctgggcgcggtcgtgcaggccgacatggggtgcgtgatcaactggaagggcaaggagctgaagtgcggcagcgggatcttcgtcaccaacgaggtgcacacgtggaccgagcagtacaagttccaggccgactcccccaagcgcctcgccaccgccatcgcgggcgcctgggagaacggggtgtgcggcatccggagcaccacgcgcatggagaacctgctgtggaagcagatcgccaacgagctcaactacatcctgtgggagaacaacatcaagctgaccgtcgtggtgggggacatcatcggcgtcctcgagcagggcaagcggaccctgacgccccagccgatggagctgaagtactcctggaagacgtgggggaaggccaagatcgtgaccgcggagacccagaacagctccttcatcatcgacggccccaacacccccgagtgccccagcgcctcccgcgcctggaacgtgtgggaggtcgaggactacgggttcggcgtgttcacgaccaacatctggctcaagctgcgggaggtgtacacccagctgtgcgaccaccgcctcatgagcgccgccgtcaaggacgagcgggcggtgcacgccgacatgggctactggatcgagagccagaagaacgggtcctggaagctggagaaggccagcctgatcgaggtgaagacctgcacctggccgaagtcccacacgctctggagcaacggcgtcctggagtccgacatgatcatccccaagagcctggccgggcccatctcccagcacaaccaccgcccgggctaccacacccagaccgccgggccctggcacctcggcaagctggagctggacttcaactactgcgagggcaccacggtggtgatcaccgagaactgcgggacccggggccccagcctccgcaccacgaccgtctccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgcgggcagcgggaaggtcgacaacttcaccatgggcgtgctgtgcctcgccatcctgttcgaggaggtgatgcgcgggaagttcggcaagaagcacatgatcgccggggtcttcttcacgttcgtgctgctcctgtccggccagatcacctggcgggacatggcccacaccctgatcatgatcggcagcaacgcctccgaccgcatggggatgggcgtgacctacctcgcgctgatcgccacgttcaagatccagcccttcctggccctcgggttcttcctgcggaagctgaccagccgcgagaacctcctgctgggcgtcggcctcgccatggcgaccaccctgcagctgcccgaggacatcgagcagatggccaacgggatcgccctcggcctgatggccctgaagctcatcacgcagttcgagacctaccagctgtggaccgccctgatcagcctgacctgctccaacacgatgttcaccctgaccgtggcgtggcgcaccgccacgctgatcctcgccggggtgagcctgctgccggtctgccagtccagctccatgcggaagaccgactggctccccatggccgtggccgcgatgggcgtgccgcccctcccgctgttcatcttcagcctcaaggacaccctgaagcgccggtcctggcccctgaacgagggggtgatggccgtgggcctcgtcagcatcctggcctccagcctgctccgcaacgacgtgcccatggccggccccctggtggccgggggcctgctcatcgcgtgctacgtcatcaccgggacgtccgccgacctgaccgtggagaaggccgccgacatcacctgggaggaggaggccgagcagaccggcgtgagccacaacctgatgatcacggtcgacgacgacgggaccatgcggatcaaggacgacgagaccgagaacatcctcaccgtgctgctgaagaccgcgctcctgatcgtgtccggcgtcttcccgtacagcatccccgccacgctgctcgtgtggcacacctggcagaagcagacccagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacctacaacgggaagcggctggagcccaactgggcgtccgtgaagaaggacctgatcagctccggcgggggctggcgcctcagcgcccagtggcagaagggggaggaggtccaggtgatcgccgtggagcccggcaagaaccccaagaacttccagacgatgcccggcaccttccagaccaccacgggggagatcggcgccatcgccctggacttcaagcccgggaccagcggctcccccatcatcaaccgggagggcaaggtcgtggggctgtacggcaacggggtggtcaccaagaacggcgggtacgtgagcggcatcgcgcagaccaacgccgagccggacggccccacgcccgagctggaggaggagatgttcaagaagcgcaacctcaccatcatggacctgcaccccgggtccggcaagacccggaagtacctgccggccatcgtgcgcgaggccatcaagcggcgcctccggaccctgatcctggcccccacgcgcgtcgtggcggccgagatggaggaggccctcaaggggctgcccatccggtaccagaccaccgccaccaagagcgagcacacgggccgcgagatcgtggacctgatgtgccacgccaccttcaccatgcggctcctgtcccccgtccgcgtgccgaactacaacctgatcatcatggacgaggcgcacttcaccgaccccgccagcatcgccgcccgcgggtacatctccacgcgggtgggcatgggcgaggcggccgccatcttcatgaccgccacgccgcccgggaccgccgacgcgttcccgcagagcaacgcccccatccaggacgaggagcgcgacatccccgagcggtcctggaacagcggcaacgagtggatcacggacttcgccgggaagaccgtctggttcgtgccctccatcaaggccggcaacgacatcgccaactgcctccgcaagaacgggaagaaggtgatccagctgagccggaagaccttcgacaccgagtaccagaagacgaagctgaacgactgggacttcgtcgtgaccaccgacatctccgagatgggcgcgaacttcaaggccgaccgcgtgatcgacccgcggcgctgcctcaagcccgtcatcctgaccgacggccccgagcgggtgatcctggccgggcccatgccggtgacggccgccagcgcggcccagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagagccgcaagaccttcgtggagctgatgcggcgcggggacctccccgtgtggctggcccacaaggtcgcctccgagggcatcaagtacacggaccggaagtggtgcttcgacgggcagcgcaacaaccagatcctggaggagaacatggacgtggagatctggaccaaggagggcgagaagaagaagctccgcccccggtggctggacgcgcgcacctacagcgacccgctggccctcaaggagttcaaggacttcgccgccggccggaagtccatcgccctggacctggtcaccgagatcgggcgcgtgcccagccacctcgcgcaccggacgcgcaacgccctggacaacctggtgatgctccacaccagcgagcacggcgggcgggcctaccgccacgccgtcgaggagctgcccgagaccatggagaccctgctcctgctgcggctcatgatcctgctgacgggcggggccatgctgttcctgatctccggcaagggcatcgggaagaccagcatcggcctgatctgcgtgatcgcgtccagcgggatgctctggatggccgagatcccgctgcagtggatcgcctccgccatcgtgctggagttcttcatgatggtcctcctgatccccgagcccgagaagcagcgcacgccccaggacaaccagctggcctacgtggtgatcggcatcctcaccctggcggccatcatcgccgccaacgagatggggctgctcgagacgaccaagcgggacctgggcatgagcaaggagccgggcgtcgtgtcccccaccagctacctggacgtggacctccaccccgcgtccgcctggaccctgtacgccgtcgccacgaccgtgatcacccccatgctgcgccacaccatcgagaacagcacggccaacgtgtccctcgcggccatcgccaaccaggccgtcgtgctgatggggctggacaagggctggccgatcagcaagatggacctcggggtgcccctgctggccctcggctgctactcccaggtcaaccccctgaccctgaccgcggccgtgctcctgctgatcacccactacgccatcatcgggcccggcctccaggccaaggccacgcgggaggcgcagaagcgcaccgccgccggcatcatgaagaacccgaccgtggacgggatcatgaccatcgacctggaccccgtcatctacgacagcaagttcgagaagcagctgggccaggtgatgctcctggtgctgtgcgccgtccagctcctgctgatgcggacgtcctgggcgctctgcgaggccctgaccctggccaccgggcccatcaccacgctctgggagggcagccccggcaagttctggaacaccaccatcgccgtgtccatggccaacatcttccgcgggagctacctggcgggcgccgggctggccttctccatcatgaagtccgtgggcaccgggaagcggggcacgggcagccagggggagaccctcggcgagaagtggaagaagaagctgaaccagctgtcccgcaaggagttcgacctctacaagaagtccgggatcaccgaggtcgaccggaccgaggccaaggagggcctgaagcgcggggagatcacccaccacgccgtgtcccggggcagcgcgaagctgcagtggttcgtggagcgcaacatggtcatcccggagggccgcgtgatcgacctcgggtgcggccgcgggggctggtcctactactgcgccgggctgaagaaggtgacggaggtccgcggctacaccaagggcgggcccggccacgaggagcccgtgcccatgagcacctacgggtggaacatcgtgaagctgatgtccggcaaggacgtcttctacctcccgcccgagaagtgcgacaccctgctgtgcgacatcggggagagctcccccagccccacggtggaggagtcccggaccatccgcgtgctgaagatggtcgagccgtggctcaagaacaaccagttctgcatcaaggtgctgaacccctacatgcccaccgtgatcgagcacctggagcggctccagcgcaagcacggcggcatgctggtccggaaccccctgagccgcaactccacccacgagatgtactggatcagcaacgggacgggcaacatcgtggcctccgtgaacatggtcagccggctcctgctgaaccgcttcaccatgacccaccggcgcccgaccatcgagaaggacgtggacctcggggccggcacgcggcacgtgaacgccgagcccgagacccccaacatggacgtcatcggcgagcgcatcaagcggatcaaggaggagcacaactccacctggcactacgacgacgagaacccgtacaagacctgggcgtaccacgggagctacgaggtgaaggccacgggctccgccagcagcatgatcaacggggtggtcaagctgctgaccaagccctgggacgtggtccccatggtgacccagatggccatgaccgacacgacccccttcggccagcagcgcgtgttcaaggagaaggtcgacacccggaccccgcgctccatgcccgggacgcggcgcgtgatgggcatcaccgcggagtggctctggcgcaccctgggccggaacaagaagccccgcctgtgcacccgggaggagttcacgaagaaggtgcgcaccaacgccgccatgggggccgtcttcaccgaggagaaccagtgggacagcgccaaggcggccgtggaggacgaggacttctggaagctcgtggaccgggagcgcgagctgcacaagctgggcaagtgcgggtcctgcgtctacaacatgatgggcaagcgggagaagaagctcggggagttcggcaaggccaagggcagccgcgccatctggtacatgtggctgggggcccggtacctggagttcgaggcgctcggcttcctgaacgaggaccactggttctcccgcgagaacagctactccggggtggagggcgaggggctgcacaagctcggctacatcctgcgggacatcagcaagatccccggcggggccatgtacgccgacgacaccgccggctgggacacgcgcatcaccgaggacgacctgcacaacgaggagaagatcacccagcagatggacccggagcaccggcagctcgccaacgcgatcttcaagctgacctaccagaacaaggtggtcaaggtgcagcgccccacgcccaccgggaccgtgatggacatcatctcccggaaggaccagcgcggcagcggccaggtcgggacctacggcctgaacaccttcacgaacatggaggcccagctcatccggcagatggagggggagggcgtgctgtccaaggccgacctggagaacccccacctcccggagaagaagatcacccagtggctggagaccaagggggtggagcgcctgaagcggatggccatcagcggcgacgactgcgtcgtgaagcccatcgacgaccgcttcgccaacgcgctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtggtgccctgccgcccccaggacgagctgatcgggcgggcccgcatctcccagggcgccgggtggagcctccgggagaccgcgtgcctgggcaaggcctacgcccagatgtggtccctgatgtacttccaccgccgggacctccgcctggccagcaacgccatctgctccgcggtccccgtgcactgggtgccgacgagccggaccacctggagcatccacgcccaccaccagtggatgaccacggaggacatgctgaccgtctggaaccgcgtgtggatcgaggacaacccctggatggaggacaagacccccgtgaccacgtgggagaacgtcccctacctcggcaagcgggaggaccagtggtgcgggtccctgatcggcctgaccagccgcgccacctgggcccagaacatcccgaccgccatccagcaggtccggtccctcatcgggaacgaggagttcctggactacatgcccagcatgaagcgcttccggaaggaggaggagtccgagggcgcgatctggtga

SEQ ID NO: 9868 - RNA, 9873 nt, synthetic construct
  misc_feature 1..9873: note = derived and/or modified CDS sequence (opt1) from DENV-3__JF808129__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcaccggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaactgcaccatgggcgtgctgtgcctcgcgatcctgttcgaggacgtcatgcgggggaagttcggcaagaagcacatgatcgccggggtgttcttcaccttcgtgctgctcctgtccggccagatcacctggcgcgacatggcccacacgctgatcatgatcggcagcaacgcctccgaccggatggggatgggcgtcacctacctcgccctgatcgcgaccttcaagatccagcccttcctggccctcgggttcttcctgcgcaagctgaccagccgggagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatgttcaccctgacggtggcctggcgcaccgcgaccctgatcctcgccggggtcagcctgctgccggtgtgccagtccagctccatgcggaagaccgactggctccccatggccgtcgccgccatgggcgtgccgcccctcccgctgttcatcttcagcctcaaggacacgctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgaccaccgtggacgacgacgggaccatgcgcatcaaggacgacgagacggagaacatcctcaccgtgctgctgaagaccgccctcaccatcgtctccggcgtgttcccgtacagcatccccgcgacgctgctggtgtggcacacctggcagaagcagacccagcggtccggcgtcctctgggacgtgcccagcccgcccgagacccagaaggccgagcaggaggagggggtgtaccgcatcaagcagcagggcatcttcgggaagacgcaggtcggcgtgggggtgcagaaggagggcgtcttccacaccatgtggcacgtgacccggggcgccgtgctgacctacaacgggaagcgcctggagcccaactgggcctccgtcaagaaggacctcatcagctacggcgggggctggcggctgtccgcgcagtggcagaagggggaggaggtccaggtgatcgccgtcgagcccggcaagaaccccaagaacttccagacgatgcccggcaccttccagaccaccacgggggagatcggcgccatcgccctggacttcaagcccgggaccagcggcagccccatcatcaaccgcgagggcaaggtggtggggctctacggcaacggggtcgtgaccaagaacggcgggtacgtgtccggcatcgcccagaccaacgcggagccggacggccccacgcccgagctggaggaggagatgttcaagaagcggaacctgaccatcatggacctgcaccccgggagcggcaagacccgcaagtacctcccggccatcgtccgggaggccatcaagcgccggctgcgcaccctgatcctcgcccccacgcgggtggtggccgcggagatggaggaggccctgaaggggctgcccatccgctaccagaccaccgccaccaagtccgagcacacgggccgggagatcgtcgacctcatgtgccacgccaccttcaccatgcgcctgctgagccccgtgcgggtgccgacctacaacctcatcatcatggacgaggcccacttcacggaccccgcgtccatcgccgcccgcgggtacatcagcacccgggtcggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtgtggttcgtgcccagcatcaaggccggcaacgacatcgccaactgcctgcggaagaacgggaagaaggtcatccagctgtcccgcaagaccttcgacacggagtaccagaagaccaagctcaacgactgggacttcgtggtgaccaccgacatcagcgagatgggcgccaacttcaaggcggaccgggtcatcgacccgcgccggtgcctgaagcccgtgatcctgaccgacggccccgagcgcgtgatcctcgccgggcccatgccggtcacggccgcctccgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacacccccgaggggatcatcccggccctgttcgagcccgagcgggagaagtccgcggccatcgacggcgagtaccgcctgaagggcgagtcccggaagacgttcgtggagctcatgcgccgcggggacctgcccgtctggctggcccacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccggtggctggacgcccgcacctactccgacccgctcgcgctgaaggagttcaaggacttcgccgccggccgcaagagcatcgccctggacctcgtgacggagatcgggcgggtgccctcccacctggcccaccgcacccggaacgcgctggacaacctcgtcatgctgcacaccagcgagcacggcgggcgcgcctaccggcacgccgtggaggagctgcccgagaccatggagacgctcctgctgctcggcctgatgatcctgctcaccgggggcgccatgctgttcctgatcagcggcaaggggatcggcaagacctccatcgggctcatctgcgtgatcgccagctccggcatgctgtggatggcggagatcccgctgcagtggatcgccagcgccatcgtcctcgagttcttcatgatggtgctgctgatccccgagcccgagaagcagcgcacgccccaggacaaccagctcgcctacgtggtcatcgggatcctgacgctggccgcgatcatcgccgccaacgagatgggcctcctggagaccaccaagcgggacctgggcatgtccaaggagccgggggtggtgagccccacctcctacctcgacgtcgacctgcaccccgccagcgcgtggacgctgtacgccgtggccaccaccgtgatcacccccatgctccgccacacgatcgagaactccaccgccaacgtcagcctggccgcgatcgccaaccaggccgtggtgctgatgggcctcgacaaggggtggccgatctccaagatggacctgggcgtccccctgctcgccctggggtgctacagccaggtgaaccccctgaccctcaccgccgcggtgctgctgctcatcacgcactacgccatcatcggccccggcctgcaggccaaggccacccgggaggcccagaagcgcaccgcggccgggatcatgaagaacccgaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggcgctgaccctcgccaccggccccatcacgaccctgtgggagggctcccccgggaagttctggaacaccaccatcgccgtgagcatggccaacatcttccgcggctcctacctggccggggcgggcctcgccttcagcatcatgaagtccgtcgggaccggcaagcggggcacggggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagatcacgcaccacgccgtgagccggggctccgccaagctccagtggttcgtcgagcgcaacatggtgatcccggaggggcgggtgatcgacctgggctgcgggcgcggcgggtggagctactactgcgcgggcctgaagaaggtcaccgaggtgcggggctacaccaagggcgggcccgggcacgaggagcccgtgcccatgtccacctacggctggaacatcgtcaagctcatgagcgggaaggacgtgttctacctgccgcccgagaagtgcgacacgctgctctgcgacatcggcgagtccagcccctcccccaccgtggaggagagccgcaccatccgcgtcctgaagatggtggagccgtggctgaagaacaaccagttctgcatcaaggtgctgaacccctacatgcccaccgtcatcgagcacctcgagcggctgcagcgcaagcacggcgggatgctggtgcggaaccccctctcccgcaacagcacgcacgagatgtactggatctccaacggcaccgggaacatcgtggccagcgtcaacatggtgtcccggctgctgctcaaccgcttcaccatgacccaccggcgcccgacgatcgagaaggacgtggacctgggcgccggcacccggcacgtcaacgccgagcccgagacccccaacatggacgtgatcggggagcgcatcaagcggaccaaggaggagcacaacagcacgtggcactacgacgacgagaacccgtacaagacctgggcctaccacggctcctacgaggtgaaggcgaccgggagcgcctccagcatgatcaacggcgtcgtgaagctgctcaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgccgagtggctgtggcggacgctggggcgcaacaagaagccccggctctgcacccgcgaggagttcaccaagaaggtccgcaccaacgcggccatgggcgccgtgttcacggaggagaaccagtgggactccgccaaggccgcggtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgccatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgcgatgtacgccgacgacaccgccgggtgggacacccgcatcaccgaggacgacctccacaacgaggagaagatcacccagcagatggacccggagcaccggcagctggccaacgccatcttcaagctgacgtaccagaacaaggtcgtgaaggtgcagcgccccacccccaccggcaccgtcatggacatcatcagccggaaggaccagcgcggctccggccaggtgggcacgtacgggctcaacaccttcaccaacatggaggcgcagctgatccggcagatggagggcgagggggtgctgagcaaggccgacctcgagaacccccacctccccgagaagaagatcacccagtggctggagacgaagggcgtcgagcgcctgaagcggatggccatctccggcgacgactgcgtggtgaagcccatcgacgaccgcttcgccaacgccctgctggcgctcaacgacatggggaaggtccggaaggacatcccccagtggcagcccagcaagggctggcacgactggcagcaggtcccgttctgctcccaccacttccacgagctgatcatgaaggacgggcgcaagctggtggtcccctgccggccccaggacgagctcatcggccgcgcccggatcagccagggggccggctggtccctgcgcgagaccgcctgcctgggcaaggcgtacgcccagatgtggagcctcatgtacttccaccgccgggacctgcgcctggcctccaacgccatctgcagcgccgtgcccgtgcactgggtcccgacctcccggaccacgtggagcatccacgcgcaccaccagtggatgaccaccgaggacatgctcaccgtgtggaaccgcgtgtggatcgaggacaacccctggatggaggacaagacgcccgtcaccacctgggagaacgtgccctacctggggaagcgggaggaccagtggtgcggcagcctgatcgggctcacctcccgcgccacgtgggcccagaacatcccgaccgccatccagcaggtccggagcctgatcggcaacgaggagttcctggactacatgccctccatgaagcgcttccggaaggaggaggagagcgagggggccatctggtga

SEQ ID NO: 9869 - RNA, 9873 nt, synthetic construct
  misc_feature 1..9873: note = derived and/or modified CDS sequence (opt1) from DENV-3__JF808123__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtggagggcctgtccggggccacctgggtggacgtggtcctggagcacggcgggtgcgtgaccacgatggccaagaacaagcccaccctcgacatcgagctgcagaagaccgaggccacccacctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctgggccccatcgaggggaaggtcgtgcagtacgagaacctcaagtacaccgtgatcatcacggtccacaccggcgaccagcaccaggtggggaacgagacccagggcgtcaccgccgagatcacgccccaggccagcaccaccgaggcgatcctgcccgagtacgggaccctgggcctcgagtgctccccgcggaccggcctggacttcaacgagatgatcctgctcacgatgaagaacaaggcctggatggtgcaccgccagtggttcttcgacctgcccctgccctggaccagcggggccaccaccgagacgcccacctggaaccggaaggagctcctggtgaccttcaagaacgcccacgccaagaagcaggaggtcgtggtgctgggctcccaggagggggcgatgcacaccgccctcacgggcgccaccgagatccagaacagcgggggcacctccatcttcgccggccacctgaagtgccgcctgaagatggacaagctcgagctgaaggggatgagctacgccatgtgcaccaacacgttcgtcctgaagaaggaggtgtccgagacccagcacggcaccatcctcatcaaggtggagtacaagggggaggacgcgccgtgcaagatccccttcagcaccgaggacggccagggcaaggcccacaacgggcggctgatcacggccaaccccgtcgtgaccaagaaggaggagcccgtgaacatcgaggccgagccgcccttcggcgagagcaacatcgtcatcgggaccggcgacaacgcgctgaagatcaactggtacaagaaggggtccagcatcggcaagatgttcgaggccaccgcccgcggcgcccggcgcatggccatcctgggggacacggcgtgggacttcggctccgtcgggggcgtgctcaacagcctggggaagatggtccaccagatcttcggctccgcctacaccgccctgttcagcggcgtgtcctgggtgatgaagatcgggatcggcgtcctcctgacctggatcgggctgaacagcaagaacacctccatgagcttctcctgcatcgccatcggcatcatcacgctctacctgggggccgtggtgcaggcggacatgggctgcgtcatcaactggaagggcaaggagctgaagtgcgggagcggcatcttcgtgaccaacgaggtgcacacctggaccgagcagtacaagttccaggccgactcccccaagcgcctcgccacggccatcgccggggcgtgggagaacggcgtctgcgggatccggagcaccacccgcatggagaacctgctgtggaagcagatcgccaacgagctcaactacatcctgtgggagaacaacatcaagctgaccgtggtggtcggcgacatcatcggcgtgctcgagcaggggaagcggacgctgacgccccagccgatggagctgaagtactcctggaagacctggggcaaggccaagatcgtgaccgccgagacgcagaacagctccttcatcatcgacgggcccaacacccccgagtgccccagcgcgtcccgcgcctggaacgtctgggaggtggaggactacggcttcggcgtgttcaccaccaacatctggctcaagctgcgggaggtctacacccagctgtgcgaccaccgcctcatgagcgccgccgtgaaggacgagcgggccgtgcacgcggacatggggtactggatcgagagccagaagaacggctcctggaagctggagaaggccagcctgatcgaggtcaagacgtgcacctggccgaagtcccacaccctctggagcaacggggtgctggagtccgacatgatcatccccaagagcctggccggccccatctcccagcacaaccaccgcccggggtaccacacccagacggccggcccctggcacctcggcaagctggagctggacttcaactactgcgaggggaccaccgtggtcatcaccgagaactgcggcacgcgggggcccagcctccgcaccaccaccgtgtccggcaagctgatccacgagtggtgctgccggagctgcacgctgcccccgctccgctacatgggggaggacggctgctggtacggcatggagatccggcccatctccgagaaggaggagaacatggtcaagagcctggtctccgccgggagcggcaaggtggacaacttcaccatgggggtgctgtgcctcgcgatcctgttcgaggaggtcatgcgcggcaagttcgggaagaagcacatgatcgccggcgtgttcttcaccttcgtgctgctcctgtccggccagatcacctggcgggacatggcccacacgctgatcatgatcgggagcaacgcctccgaccgcatgggcatgggggtcacctacctcgccctgatcgcgaccttcaagatccagcccttcctggccctcggcttcttcctgcggaagctgaccagccgcgagaacctcctgctgggcgtggggctcgccatggccacgaccctgcagctgcccgaggacatcgagcagatggcgaacggcatcgccctcgggctgatggccctgaagctcatcacccagttcgagacctaccagctgtggacggccctgatcagcctgacctgctccaacaccatgttcaccctgacggtggcctggcggaccgcgaccctgatcctcgccggcgtcagcctgctgccggtgtgccagtccagctccatgcgcaagaccgactggctccccatggccgtcgccgccatgggggtgccgcccctcccgctgttcatcttcagcctcaaggacacgctgaagcgccggtcctggcccctgaacgagggcgtgatggcggtcggcctcgtgagcatcctggcctccagcctgctccgcaacgacgtgcccatggccgggcccctggtcgccggcgggctgctcatcgcctgctacgtgatcaccggcacctccgcggacctgaccgtggagaaggccgccgacatcacgtgggaggaggaggccgagcagaccggggtcagccacaacctgatgatcaccgtggacgacgacggcaccatgcggatcaaggacgacgagaccgagaacatcctcacggtgctgctgaagaccgccctcctgatcgtctccggcgtgttcccgtacagcatccccgcgaccctgctcgtgtggcacacctggcagaagcagacgcagcgctccggggtcctgtgggacgtgcccagcccgcccgagacccagaaggccgagctggaggagggcgtgtaccggatcaagcagcaggggatcttcggcaagacccaggtcggggtgggcgtgcagaaggagggcgtcttccacaccatgtggcacgtgacgcgcggggccgtgctcacctacaacggcaagcggctggagcccaactgggcctccgtcaagaaggacctgatcagctacgggggcgggtggcgcctctccgcgcagtggcagaagggcgaggaggtccaggtgatcgccgtcgagcccggcaagaaccccaagaacttccagaccatgcccgggaccttccagacgaccaccggcgagatcggggccatcgccctggacttcaagcccggcaccagcggcagccccatcatcaaccgggaggggaaggtggtgggcctgtacgggaacggcgtcgtgacgaagaacgggggctacgtgtccggcatcgcccagaccaacgcggagccggacgggcccacccccgagctggaggaggagatgttcaagaagcgcaacctcaccatcatggacctgcaccccggcagcgggaagacgcggaagtacctgccggccatcgtccgcgaggccatcaagcggcgcctccggaccctgatcctggcccccacccgcgtggtggccgcggagatggaggaggccctcaagggcctgcccatccggtaccagaccacggccaccaagtccgagcacaccgggcgcgagatcgtcgacctgatgtgccacgccaccttcacgatgcggctcctgagccccgtgcgcgtgccgaactacaacctgatcatcatggacgaggcccacttcaccgaccccgcgtccatcgccgcccggggctacatcagcacccgcgtcggcatgggggaggccgcggccatcttcatgaccgccacgccgcccggcaccgccgacgccttcccgcagtccaacgcgcccatccaggacgaggagcgcgacatccccgagcggagctggaactccgggaacgagtggatcaccgacttcgccggcaagaccgtgtggttcgtgcccagcatcaaggccgggaacgacatcgccaactgcctccgcaagaacggcaagaaggtcatccagctgtcccggaagacgttcgacaccgagtaccagaagaccaagctgaacgactgggacttcgtggtgaccacggacatcagcgagatgggcgccaacttcaaggcggaccgcgtcatcgacccgcggcgctgcctcaagcccgtgatcctgaccgacgggcccgagcgggtgatcctggccggccccatgccggtcaccgccgcctccgccgcgcagcgccgggggcgcgtgggccggaacccccagaaggagaacgaccagtacatcttcaccgggcagcccctcaacaacgacgaggaccacgcccactggaccgaggccaagatgctgctggacaacatcaacacgcccgagggcatcatcccggccctcttcgagcccgagcgcgagaagtccgcggccatcgacggcgagtaccggctgaagggggagtcccgcaagaccttcgtggagctgatgcggcgcggcgacctccccgtctggctggcccacaaggtggccagcgaggggatcaagtacaccgaccggaagtggtgcttcgacggccagcgcaacaaccagatcctggaggagaacatggacgtcgagatctggaccaaggagggcgagaagaagaagctccggccccgctggctggacgcccgcacgtactccgacccgctggcgctcaaggagttcaaggacttcgccgccgggcgcaagagcatcgccctggacctggtgaccgagatcggccgcgtgccctcccacctcgcccaccggacccgcaacgcgctggacaacctggtcatgctccacaccagcgagcacgggggccgggcctaccgccacgccgtggaggagctgcccgagacgatggagaccctgctcctgctggggctcatgatcctgctgaccggcggcgccatgctgttcctgatcagcgggaagggcatcgggaagacctccatcggcctgatctgcgtgatcgccagctccgggatgctctggatggcggagatcccgctgcagtggatcgccagcgccatcgtcctggagttcttcatgatggtgctcctgatccccgagcccgagaagcagcggacgccccaggacaaccagctggcctacgtggtcatcggcatcctcaccctggccgcgatcatcgccgccaacgagatgggcctgctcgagaccaccaagcgcgacctggggatgtccaaggagccgggcgtggtgagccccacgtcctacctggacgtcgacctccaccccgccagcgcgtggaccctgtacgccgtggccaccaccgtgatcacgcccatgctgcggcacaccatcgagaactccaccgccaacgtcagcctcgccgcgatcgccaaccaggccgtggtgctgatggggctggacaagggctggccgatctccaagatggacctcggggtccccctgctggccctcggctgctacagccaggtgaaccccctgaccctgacggccgcggtgctcctgctgatcacccactacgccatcatcggccccgggctccaggccaaggccacccgcgaggcccagaagcggaccgcggccggcatcatgaagaacccgacggtcgacgggatcatgaccatcgacctggaccccgtgatctacgactccaagttcgagaagcagctgggccaggtgatgctcctggtcctgtgcgccgtgcagctcctgctgatgcgcaccagctgggccctctgcgaggcgctgaccctggccacgggccccatcaccaccctctgggaggggtcccccggcaagttctggaacaccacgatcgccgtgagcatggccaacatcttccgggggtcctacctggccggcgcggggctggccttcagcatcatgaagtccgtcggcaccggcaagcgcgggaccggcagccagggggagaccctcggcgagaagtggaagaagaagctgaaccagctgagccggaaggagttcgacctctacaagaagtccgggatcaccgaggtggaccgcacggaggccaaggagggcctgaagcggggcgagatcacccaccacgccgtgagccgcgggtccgccaagctgcagtggttcgtcgagcggaacatggtgatcccggagggccgcgtgatcgacctcgggtgcggccgcgggggctggagctactactgcgcgggcctgaagaaggtcaccgaggtgcgcgggtacaccaagggcgggcccggccacgaggagcccgtgcccatgtccacgtacgggtggaacatcgtcaagctgatgagcggcaaggacgtgttctacctcccgcccgagaagtgcgacaccctgctgtgcgacatcggcgagtccagcccctcccccaccgtggaggagagccgcaccatccgggtcctgaagatggtggagccgtggctcaagaacaaccagttctgcatcaaggtgctgaacccctacatgcccacggtcatcgagcacctggagcgcctccagcggaagcacgggggcatgctggtgcgcaaccccctgtcccggaacagcacccacgagatgtactggatctccaacgggaccggcaacatcgtggccagcgtcaacatggtgtcccgcctcctgctgaaccggttcaccatgacgcaccgccggccgaccatcgagaaggacgtggacctcggcgccgggacccgccacgtcaacgccgagcccgagacccccaacatggacgtgatcggcgagcggatcaagcgcatcaaggaggagcacaacagcacgtggcactacgacgacgagaacccgtacaagacctgggcctaccacgggtcctacgaggtgaaggcgaccggcagcgcctccagcatgatcaacggggtcgtgaagctgctgaccaagccctgggacgtcgtgcccatggtgacgcagatggccatgaccgacaccacccccttcggccagcagcgggtcttcaaggagaaggtggacacgcgcaccccgcggagcatgcccggcacccgccgggtgatggggatcaccgccgagtggctctggcgcacgctgggccggaacaagaagccccgcctgtgcacccgcgaggagttcaccaagaaggtccggaccaacgcggccatgggggccgtgttcacggaggagaaccagtgggactccgccaaggccgcggtggaggacgaggacttctggaagctcgtcgaccgcgagcgggagctgcacaagctgggcaagtgcgggagctgcgtgtacaacatgatgggcaagcgcgagaagaagctcggcgagttcgggaaggccaagggctcccgggccatctggtacatgtggctgggggcccgctacctggagttcgaggccctcggcttcctgaacgaggaccactggttcagccgggagaactcctacagcggggtggagggcgagggcctgcacaagctcgggtacatcctgcgcgacatctccaagatccccggcggggcgatgtacgccgacgacaccgccggctgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcgggggtccggccaggtggggacgtacggcctgaacaccttcaccaacatggaggcgcagctcatccgccagatggagggggagggcgtgctgagcaaggccgacctggagaacccccacctcccggagaagaagatcacccagtggctggagacgaagggcgtcgagcggctgaagcgcatggccatctccggggacgactgcgtggtgaagcccatcgacgaccggttcgccaacgccctcctggcgctgaacgacatgggcaaggtccgcaaggacatcccccagtggcagcccagcaaggggtggcacgactggcagcaggtcccgttctgctcccaccacttccacgagctcatcatgaaggacggccggaagctggtggtcccctgccgcccccaggacgagctgatcgggcgggcccgcatcagccagggcgccggctggtccctccgcgagaccgcctgcctggggaaggcgtacgcccagatgtggagcctgatgtacttccaccggcgcgacctccggctggcctccaacgccatctgcagcgccgtgcccgtgcactgggtcccgacctcccgcaccacgtggagcatccacgcgcaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgacctcccgggccacgtgggcccagaacatcccgaccgccatccagcaggtccgcagcctcatcgggaacgaggagttcctggactacatgccctccatgaagcggttccgcaaggaggaggagagcgagggcgccatctggtga

SEQ ID NO: 9870 - RNA, 9873 nt, synthetic construct
  misc_feature 1..9873: note = derived and/or modified CDS sequence (opt1) from DENV-3__JF808128__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcaccagcctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagcggaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcctggacctgcccctcccctggaccagcggcgccaccaccgagacgcccacctggaaccggaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccgcctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctcggcgacaccgcgtgggacttcgggtccgtgggcggggtgctgaacagcctgggcaagatggtccaccagatcttcgggtccgcctacacggccctcttcagcggcgtgtcctgggtgatgaagatcggcatcggggtcctgctgacctggatcggcctcaacagcaagaacacctccatgagcttctcctgcatcgccatcgggatcatcaccctgtacctgggcgccgtggtgcaggcggacatggggtgcgtcatcaactggaagggcaaggagctcaagtgcggcagcgggatcttcgtgacgaacgaggtgcacacctggaccgagcagtacaagttccaggccgactcccccaagcgcctggccaccgccatcgccggcgcgtgggagaacggggtctgcggcatccggagcacgacccgcatggagaacctgctctggaagcagatcgccaacgagctgaactacatcctgtgggagaacaacatcaagctcaccgtggtggtcggggacatcatcggcgtgctggagcagggcaagcggaccctgacgccccagccgatggagctcaagtactcctggaagacctggggcaagagcaagatcgtgaccgccgagacccagaactccagcttcatcatcgacggccccaacacgcccgagtgcccctccgccagccgcgcgtggaacgtctgggaggtggaggactacgggttcggcgtgttcaccaccaacatctggctgaagctgcgggaggtctacacccagctctgcgaccaccgcctgatgagcgccgccgtgaaggacgagcgggccgtgcacgccgacatgggctactggatcgagtcccagaagaacgggagctggaagctggagaaggcgtccctcatcgaggtcaagacctgcacgtggcccaagagccacaccctgtggtccaacggcgtgctggagagcgacatgatcatccccaagtccctcgccgggcccatcagccagcacaaccaccgcccgggctaccacacccagaccgccgggccctggcacctgggcaagctggagctcgacttcaactactgcgagggcacgaccgtggtcatcaccgagaactgcgggacccggggccccgccctgcgcacgaccaccgtgtccgggaagctgatccacgagtggtgctgccggagctgcaccctgccgcccctgcgctacatgggcgaggacgggtgctggtacggcatggagatccggcccatctccgagaaggaggagaacatggtcaagagcctggtctccgccggcagcgggaaggtggacaacttcacgatgggcgtgctctgcctggcgatcctgttcgaggaggtcatgcgcgggaagttcggcaagaagcacatgatcgccggggtgttcttcaccttcgtgctcctgctgtccggccagatcacctggcgggacatggcccacaccctcatcatgatcggcagcaacgcctccgaccgcatggggatgggcgtcacgtacctggccctgatcgcgaccttcaagatccagcccttcctcgccctggggttcttcctgcggaagctcaccagccgcgagaacctgctgctcggcgtgggcctggccatggccaccacgctgcagctccccgaggacatcgagcagatggcgaacgggatcgccctgggcctgatggccctcaagctgatcacccagttcgagacctaccagctgtggaccgccctcatcagcctgacgtgctccaacaccatgttcaccctgaccgtggcctggcggacggcgaccctcatcctggccggggtcagcctgctcccggtgtgccagtccagctccatgcgcaagaccgactggctgcccatggccgtcgccgccatgggcgtgccgcccctccccctcttcatcttcagcctgaaggacaccctgaagcgccggtcctggcccctcaacgagggggtgatggcggtcggcctggtgagcatcctggcctccagcctcctgcgcaacgacgtgcccatggccggccccctggtcgccgggggcctcctgatcgcctgctacgtgatcacggggacctccgcggacctgaccgtggagaaggccgccgacatcacctgggaggaggaggccgagcagacgggcgtcagccacaacctcatgatcaccgtggacgacgacgggaccatgcggatcaaggacgacgagaccgagaacatcctgaccgtgctgctcaagacggccctgctgatcgtctccggcgtgttcccgtacagcatccccgcgaccctcctggtgtggcacacctggcagaagcagacccagcgctccggcgtcctgtgggacgtgccctccccgcccgagacgcagaaggccgagctcgaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctggagcccaactgggcctccgtcaagaaggacctcgtgagctacggcgggggctggcgcctgtccgcgcagtggcagaagggggaggaggtgcaggtcatcgccgtggagcccggcaagaaccccaagaacttccagaccatgccgggcaccttccagaccacgaccggggagatcggcgccatcgccctggacttcaagcccgggaccagcggcagccccatcatcaaccgggagggcaaggtggtcgggctgtacggcaacggggtggtgaccaagaacggcgggtacgtctccggcatcgcccagacgaacgcggagccggacggccccacccccgagctcgaggaggagatgttcaagaagcgcaacctgaccatcatggacctgcaccccgggagcggcaagacccggaagtacctcccggccatcgtgcgcgaggccatcaagcggcgcctgcggacgctgatcctcgcccccacccgcgtggtcgccgcggagatggaggaggccctgaaggggctgcccatccggtaccagaccaccgccacgaagtccgagcacaccggccgcgagatcgtggacctcatgtgccacgccaccttcaccatgcggctgctgagccccgtgcgcgtcccgaactacaacctcatcatcatggacgaggcccacttcacggaccccgcgtccatcgccgcccgggggtacatcagcacccgcgtgggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtccccagcatcaaggccggcaacgacatcgccaactgcctgcgcaagaacgggaagaaggtgatccagctgtcccggaagaccttcgacacggagtaccagaagaccaagctcaacgactgggacttcgtggtcaccaccgacatcagcgagatgggcgccaacttcaaggcggaccgcgtgatcgacccgcggcgctgcctgaagcccgtgatcctgacggacggccccgagcgggtcatcctcgccgggcccatgccggtgaccgccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacacccccgaggggatcatcccggccctgttcgagcccgagcgcgagaagtccgcggccatcgacggcgagtaccggctgaagggcgagtcccgcaagacgttcgtcgagctcatgcggcgcggggacctgcccgtgtggctggcccacaaggtcgccagcgagggcatcaagtacaccgaccggcgctggtgcttcgacgggcagcggaacaaccagatcctcgaggagaacatggacgtggagatctggaccaaggagggcgagaagaagaagctgcgcccccgctggctggacgcccggacctactccgacccgctcgcgctgaaggagttcaaggacttcgccgccggccgcaagagcatcgccctggacctcgtgacggagatcgggcgggtcccctcccacctggcccaccgcacccggaacgcgctggacaacctcgtgatgctgcacaccagcgagcacggcgggcgcgcctaccggcacgccgtggaggagctgcccgagaccatggagacgctcctgctgctcggcctgatgatcctgctcaccgggggcgccatgctgttcctgatcagcggcaaggggatcggcaagacctccatcgggctcatctgcgtcatcgccagccgctccatgagctggatggcggagatcccgctgcagtggatcgcctccgccatcgtgctggagttcttcatgatggtgctcctgatccccgagcccgagaagcagcggacgccccaggacaaccagctggcctacgtcgtgatcggcatcctcacgctggccgcgatcatcgccgccaacgagatggggctgctcgagaccaccaagcgcgacctgggcatgagcaaggagccgggcgtggtctcccccaccagctacctggacgtggacctccaccccgcctccgcgtggacgctgtacgccgtggccaccaccgtcatcacccccatgctgcggcacacgatcgagaacagcaccgccaacgtgtccctcgccgcgatcgccaaccaggccgtggtcctgatggggctggacaagggctggccgatcagcaagatggacctcggggtgcccctgctggccctcggctgctactcccaggtgaaccccctgaccctgaccgccgcggtcctcctgctgatcacgcactacgccatcatcgggcccggcctccaggccaaggccacccgcgaggcccagaagcggaccgcggccggcatcatgaagaacccgaccgtggacgggatcatgacgatcgacctggaccccgtgatctacgacagcaagttcgagaagcagctgggccaggtcatgctcctggtgctgtgcgccgtgcagctcctgctgatgcgcacctcctgggccctctgcgaggcgctgaccctggccaccgggcccatcacgaccctctgggagggcagccccggcaagttctggaacaccaccatcgccgtctccatggccaacatcttccgggggagctacctggccggcgcggggctggccttctccatcatgaagtccgtgggcacggggaagcgcggcaccggcagccagggggagaccctcggcgagaagtggaagaagaagctgaaccagctgtcccggaaggagttcgacctctacaagaagtccgggatcaccgaggtggaccgcaccgaggccaaggagggcctgaagcgcggggagatcacgcaccacgccgtctcccgcggcagcgccaagctgcagtggttcgtggagcggaacatggtgatcccggagggccgcgtcatcgacctcgggtgcggccgcgggggctggtcctactactgcgcggggctgaagaaggtgaccgaggtgcggggctacaccaagggcgggcccggccacgaggagcccgtccccatgagcacctacgggtggaacatcgtgaagctgatgtccggcaaggacgtgttctacctcccgcccgagaagtgcgacacgctgctgtgcgacatcggggagagctcccccagccccaccgtcgaggagtcccgcaccatccgggtgctgaagatggtggagccgtggctcaagaacaaccagttctgcatcaaggtcctgaacccctacatgcccaccgtgatcgagcacctggagcgcctccagcggaagcacggcggcatgctggtgcgcaaccccctgagccggaactccacgcacgagatgtactggatcagcaacgggaccggcaacatcgtcgcctccgtgaacatggtgagccgcctcctgctgaaccggttcaccatgacccaccgccggccgacgatcgagaaggacgtcgacctcggggccggcacccgccacgtgaacgccgagcccgagacccccaacatggacgtgatcggcgagcggatcaagcgcatcaaggaggagcacaactccacctggcactacgacgacgagaacccgtacaagacgtgggcctaccacgggagctacgaggtcaaggcgaccggctccgccagcagcatgatcaacggggtggtcaagctgctgaccaagccctgggacgtggtgcccatggtcacccagatggccatgacggacaccacccccttcggccagcagcgggtgttcaaggagaaggtggacacccgcacgccgcggtccatgcccgggacccgccgggtcatgggcatcaccgccgagtggctctggcgcaccctgggccgcaacaagaagccccggctgtgcacgcgcgaggagttcaccaagaaggtgcggaccaacgcggccatgggggccgtgttcaccgaggagaaccagtgggacagcgccaaggccgcggtcgaggacgaggacttctggaagctcgtggaccgcgagcgggagctgcacaagctgggcaagtgcgggtcctgcgtgtacaacatgatgggcaagcgcgagaagaagctcggggagttcggcaaggccaagggcagccgggccatctggtacatgtggctgggggcccgctacctggagttcgaggccctcggcttcctgaacgaggaccactggttctcccgggagaacagctactccggggtcgagggcgaggggctgcacaagctcggctacatcctgcgcgacatcagcaagatccccggcggggcgatgtacgccgacgacacggccggctgggacacccggatcaccgaggacgacctgcacaacgaggagaagatcacccagcagatggacccggagcaccgccagctcgccaacgccatcttcaagctgacgtaccagaacaaggtggtgaaggtccagcggcccacccccaccgggaccgtgatggacatcatctcccgcaaggaccagcggggcagcggccaggtggggacctacggcctgaacacgttcaccaacatggaggcgcagctcatccgccagatggagggggagggcgtcctgtccaaggccgacctggagaacccccacctcccggagaagaagatcacccagtggctggagaccaagggggtggagcggctgaagcgcatggccatcagcggcgacgactgcgtggtcaagcccatcgacgaccggttcgccaacgccctcctggcgctgaacgacatgggcaaggtgcgcaaggacatcccccagtggcagccctccaaggggtggcacgactggcagcaggtcccgttctgcagccaccacttccacgagctcatcatgaaggacggccggaagctggtcgtgccctgccgcccccaggacgagctgatcgggcgcgcccggatctcccagggcgccgggtggagcctccgcgagacggcctgcctgggcaaggcgtacgcccagatgtggtccctgatgtacttccaccggcgcgacctccggctggccagcaacgccatctgctccgccgtgcccgtccactgggtgccgaccagccgcaccacctggagcatccacgcgcaccaccagtggatgacgaccgaggacatgctgaccgtgtggaaccgggtctggatcgaggacaacccctggatggaggacaagacccccgtgacgacctgggagaacgtgccctacctcggcaagcgcgaggaccagtggtgcgggtccctgatcggcctgaccagccgggccacctgggcccagaacatcccgacggccatccagcaggtccgctccctcatcgggaacgaggagttcctggactacatgcccagcatgaagcggttccgcaaggaggaggagtccgagggcgccatctggtga

SEQ ID NO: 9871 - RNA, 9873 nt, synthetic construct
  misc_feature 1..9873: note = derived and/or modified CDS sequence (opt1) from DENV-3__JF808122__SS-prME
  source 1..9873: mol_type = other RNA
accagcctgtgcctgatgatgatcctgcccgccgccctggccttccacctcaccagccgggacggggagccgcggatgatcgtggggaagaacgagcgcggcaagagcctgctgttcaagaccgccagcgggatcatcaagtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggcgccccacctggcgaccctccgcaagctgtgcatcgagggcaagatcacgaacatcaccaccgacagccggtgcccgacccagggcgaggccgtgctgcccgaggagcaggaccagaactacgtctgcaagcacacgtacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggccagcacgaccgaggcgatcctgccggagtacggcaccctggggctcgagtgcagcccccggaccggcctggacttcaacgagatgatcctgctcaccatgaagaacaaggcctggatggtgcaccgccagtggttcttcgacctgcccctgccctggacgagcggcgccaccaccgagaccccgacgtggaaccggaaggagctcctggtgaccttcaagaacgcccacgccaagaagcaggaggtcgtggtgctggggtcccaggagggcgcgatgcacaccgccctcaccggggccacggagatccagaacagcggcgggacctccatcttcgccggccacctgaagtgccgcctgaagatggacaagctcgagctgaagggcatgagctacgccatgtgcaccaacaccttcgtcctgaagaaggaggtgtccgagacgcagcacgggaccatcctcatcaaggtggagtacaagggcgaggacgcgccctgcaagatccccttcagcaccgaggacgggcagggcaaggcccacaacggccggctgatcaccgccaaccccgtcgtgacgaagaaggaggagccggtgaacatcgaggccgagccgcccttcggggagagcaacatcgtcatcggcaccggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccggagcacgacccgcatggagaacctgctgtggaagcagatcgccaacgagctcaactacatcctgtgggagaacaacatcaagctgaccgtggtggtcggggacatcatcggcgtgctcgagcagggcaagcggaccctgacgccgcagcccatggagctgaagtactcctggaagacctgggggaaggccaagatcgtgaccgccgagacccagaacagctccttcatcatcgacggccccaacacgcccgagtgcccgagcgcgtcccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacctgcacgtggcccaagtcccacaccctctggagcaacggcgtgctggagtccgacatgatcatccccaagagcctggccgggccgatctcccagcacaaccaccgccccggctaccacacccagaccgccgggccctggcacctcggcaagctggagctggacttcaactactgcgagggcacgaccgtggtcatcaccgagaactgcgggacccggggccccagcctccgcacgaccaccgtgtccgggaagctgatccacgagtggtgctgccggagctgcaccctgccgcccctccgctacatgggcgaggacgggtgctggtacggcatggagatccggcccatctccgagaaggaggagaacatggtcaagagcctggtctccgccggcagcgggaaggtggacaacttcacgatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacaccctgatcatgatcggcagcaacgcctccgaccgcatggggatgggcgtcacgtacctcgccctgatcgcgaccttcaagatccagcccttcctggccctcgggttcttcctgcggaagctgaccagccgcgagaacctcctgctgggcgtgggcctcgccatggccaccacgctgcagctgccggaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcggacggcgaccctgatcctcgccggggtcagcctgctgcccgtgtgccagtccagctccatgcgcaagaccgactggctccccatggccgtcgccgccatgggcgtgcccccgctgcccctgttcatcttcagcctcaaggacaccctgaagcgccggtcctggcccctgaacgagggggtgatggcggtcggcctcgtgagcatcctggcctccagcttcctgcgcaacgacgtgcccatggccggcccgctcgtcgccgggggcctgctgatcgcctgctacgtgatcacggggacctccgcggacctcaccgtggagaaggccgccgacatcacctgggaggaggaggccgagcagacgggcgtcagccacaacctgatgatcaccgtggacgacgacgggaccatgcggatcaaggacgacgagaccgagaacatcctgaccgtgctcctgaagacggccctgctcatcgtctccggcgtgttcccctacagcatccccgcgaccctgctggtgtggcacacctggcagaagcagacccagcgctccggcgtcctctgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggcctccgtcaagaaggacctgatcagctacggcgggggctggcgcctgtccgcgcagtggcagaagggggaggaggtccaggtgatcgccgtcgagcccggcaagaacccgaagaacttccagaccatgcccggcaccttccagaccacgaccggggagatcggcgccatcgccctcgacttcaagcccgggaccagcggcagcccgatcatcaaccgggagggcaaggtggtggggctgtacggcaacggggtcgtgaccaagaacggcgggtacgtgtccggcatcgcccagacgaacgcggagcccgacggccccacccccgagctggaggaggagatgttcaagaagcgcaacctgaccatcatggacctccacccggggagcggcaagacccggaagtacctgcccgccatcgtccgcgaggccatcaagcggcgcctgcggacgctcatcctggcccccacccgcgtggtggccgcggagatggaggaggccctgaaggggctccccatccggtaccagaccaccgccacgaagtccgagcacaccggccgcgagatcgtcgacctgatgtgccacgccaccttcaccatgcggctgctcagcccggtgcgcgtgcccaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccccagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctctcccggaagaccttcgacacggagtaccagaagaccaagctgaacgactgggacttcgtggtgaccaccgacatcagcgagatgggcgccaacttcaaggcggaccgcgtcatcgacccccggcgctgcctgaagcccgtgatcctcacggacggccccgagcgggtgatcctggccgggccgatgcccgtcaccgccgcctccgccgcgcagcgccggggccgcgtggggcggaacccccagaaggagaacgaccagtacatcttcaccggccagcccctgaacaacgacgaggaccacgcccactggaccgaggccaagatgctcctggacaacatcaacaccccggaggggatcatccccgccctgttcgagcccgagcgcgagaagtccgcggccatcgacggcgagtaccggctcaagggcgagtcccgcaagacgttcgtggagctgatgcggcgcggggacctgcccgtctggctcgcccacaaggtggccagcgagggcatcaagtacaccgaccggaagtggtgcttcgacgggcagcgcaacaaccagatcctggaggagaacatggacgtcgagatctggaccaaggagggcgagaagaagaagctgcggccgcgctggctcgacgcccgcacctactccgaccccctggcgctgaaggagttcaaggacttcgccgccggccgcaagagcatcgccctcgacctggtgacggagatcgggcgcgtgccctcccacctggcccaccggacccgcaacgcgctcgacaacctggtcatgctgcacaccagcgagcacggcgggcgggcctaccgccacgccgtggaggagctcccggagaccatggagacgctgctgctcctgggcctgatgatcctcctgaccgggggcgccatgctgttcctcatcagcggcaaggggatcggcaagacctccatcgggctgatctgcgtgatcgccagctccggcatgagctggatggcggagatccccctgcagtggatcgcctccgccatcgtcctcgagttcttcatgatggtgctgctgatccccgagcccgagaagcagcggaccccgcaggacaaccagctcgcctacgtggtcatcgggatcctgacgctggccgcgatcatcgccgccaacgagatgggcctcctggagaccaccaagcgcgacctgggcatgagcaaggagcccggggtggtgtcccccaccagctacctcgacgtcgacctgcaccccgcctccgcgtggacgctgtacgccgtggccaccaccgtgatcaccccgatgctccggcacacgatcgagaacagcaccgccaacgtctccctggccgcgatcgccaaccaggccgtggtgctgatgggcctcgacaaggggtggcccatcagcaagatggacctgggcgtccccctgctcgccctggggtgctactcccaggtgaaccccctgaccctcaccgccgcggtgctgctgctcatcacgcactacgccatcatcggcccgggcctgcaggccaaggccacccgcgaggcccagaagcggaccgcggccgggatcatgaagaaccccaccgtcgacggcatcatgacgatcgacctggaccccgtgatctacgacagcaagttcgagaagcagctcggccaggtgatgctgctggtcctctgcgccgtgcagctgctgctcatgcgcacctcctgggccctgtgcgaggcgctgaccctcgccaccggccccatcacgaccctgtgggagggcagcccggggaagttctggaacaccaccatcgccgtgtccatggccaacatcttccggggcagctacctggccggggcgggcctcgccttctccatcatgaagtccgtcgggacgggcaagcgcggcaccgggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagatcacgcaccacgccgtgtcccgcggcagcgccaagctccagtggttcgtcgagcggaacatggtgatccccgaggggcgcgtgatcgacctgggctgcgggcggggcgggtggtcctactactgcgcgggcctgaagaaggtcaccgaggtgcgcggctacaccaagggcgggcccgggcacgaggagcccgtgccgatgagcacctacggctggaacatcgtcaagctcatgtccgggaaggacgtgttctacctgccgcccgagaagtgcgacacgctgctctgcgacatcggcgagagctcccccagcccgaccgtggaggagtcccgcaccatccgggtcctgaagatggtggagccctggctgaagaacaaccagttctgcatcaaggtgctgaacccctacatgcccaccgtcatcgagcacctcgagcgcctgcagcggaagcacggcgggatgctggtgcgcaacccgctcagccggaactccacgcacgagatgtactggatcagcaacggcaccgggaacatcgtggcctccgtcaacatggtgagccgcctgctgctcaaccggttcaccatgacccaccgccggcccacgatcgagaaggacgtggacctgggcgccggcacccgccacgtcaacgccgagcccgagaccccgaacatggacgtgatcggggagcggatcaagcgcatcaaggaggagcacaactccacctggcactacgacgacgagaacccctacaagacgtgggcctaccacggcagctacgaggtgaaggcgaccgggtccgccagcagcatgatcaacggcgtcgtgaagctgctcaccaagccctgggacgtcgtgcccatggtgacccagatggccatgacggacaccaccccgttcgggcagcagcgggtcttcaaggagaaggtggacacccgcacgccccggtccatgcccggcacccgccgggtgatgggcatcaccgccgagtggctgtggcgcaccctggggcggaacaagaagccccgcctctgcacgcgcgaggagttcaccaagaaggtccggaccaacgcggccatgggcgccgtgttcaccgaggagaaccagtgggacagcgccaaggccgcggtggaggacgaggacttctggaagctggtcgaccgcgagcgggagctgcacaagctcgggaagtgcggctcctgcgtgtacaacatgatggggaagcgcgagaagaagctgggcgagttcggcaaggccaacgggagccgggccatctggtacatgtggctgggcgcccgctacctcgagttcgaggccctggggttcctgaaggagtaccactggttctcccgggagaacagctactccggcgtggagggggagggcctccacaagctgggctacatcctgcgcgacatcagcaagatccccggcggggcgatgtacgccgacgacacggccgggtgggacacccggatcaccgaggacgacctccacaacgaggagaagatcacccagcagatggaccccgagcaccgccagctggccaacgccatcttcaagctgacgtaccagaacaaggtcgtgaaggtgcagcggcccacccccaccgggaccgtcatggacatcatctcccgcaaggaccagcggggcagcggccaggtgggcacctacgggctcaacacgttcaccaacatggaggcgcagctgatccgccagatggagggcgagggggtgctgtccaaggccgacctcgagaacccgcacctccccgagaagaagatcacccagtggctggagaccaagggcgtcgagcggctcaagcgcatggccatcagcggcgacgactgcgtggtgaagcccatcgacgaccggttcgccaacgccctgctggcgctcaacgacacggggaaggtccgcaaggacatcccccagtggcagccgtccaagggctggcacgactggcagcaggtccccttctgcagccaccacttccacgagctgatcatgaaggacgggcggaagctggtggtcccctgccgcccccaggacgagctcatcggccgggcccgcatctcccagggggccggctggagcctgcgcgagaccgcctgcctgggcaaggcgtacgcccagatgtggtccctcatgtacttccaccggcgcgacctgcggctggccagcaacgccatctgctccgccgtgccggtgcactgggtccccaccagccgcaccacgtggagcatccacgcgcaccaccagtggatgaccaccgaggacatgctcaccgtgtggaaccgggtgtggatcgaggacaacccctggatggaggacaagacgcccgtcaccacctgggagaacgtgccgtacctggggaagcgcgaggaccagtggtgcggctccctgatcgggctcaccagccgggccacgtgggcccagaacatccccaccgccatccagcaggtccgctccctgatcggcaacgaggagttcctggactacatgcccagcatgaagcggttccgcaaggaggaggagtccgagggggccatctggtga

SEQ ID NO: 9872 - RNA, 9873 nt, synthetic construct
  misc_feature 1..9873: note = derived and/or modified CDS sequence (opt1) from DENV-3__GQ466079__SS-prME
  source 1..9873: mol_type = other RNA
accagcctgtgcctcatgatgatcctgcccgccgccctggcgttccacctcaccagccgcgacggcgagccgcggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagcttcttcatcatcgacggccccaacacccccgagtgcccctccgcgagccgggcctggaacgtctgggaggtggaggactacgggttcggcgtgttcaccaccaacatctggctcaagctgcgcgaggtctacacccagctgtgcgaccaccggctcatgtccgccgccgtgaaggacgagcgcgccgtgcacgcggacatgggctactggatcgagagccagaagaacgggagctggaagctggagaaggcctccctgatcgaggtcaagacgtgcacctggcccaagtcccacaccctctggtccaacggcgtgctggagagcgacatgatcatccccaagtccctggccgggcccatcagccagcacaaccaccggccgggctaccacacccagacggccgggccctggcacctcgagaacctggagctggacttcacctactgcgagggcaccaccgtggtcatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcagcgagaaggaggagaacatggtgaagtccctggtcagcgccggctccggcaaggtggacaacttcaccatggggatcctgtgcctcgcgatcctgttcgaggaggtgatgcggggcaagttcgggaagaagcacatgatcgccggcgtcttcttcaccttcgtgctgctcctgagcgggcagatcacgtggcgcgacatggcccacaccctgatcatgatcggctccaacgccagcgaccggatgggcatgggggtgacctacctcgccctgatcgcgaccttcaagatccagcccttcctggccctcggcttcttcctgcgcaagctgacgtcccgggagaacctcctgctgggggtcggcctcgccatggccaccaccctgcagctgcccgaggacatcgagcagatggcgaacggcatcgccctcgggctgatggccctgaagctcatcacccagttcgagacgtaccagctgtggaccgccctgatcagcctgacctgcagcaacaccatcttcacgctgaccgtggcctggcgcaccgcgaccctgatcctcgccggcgtgtccctgctgccggtctgccagagctccagcatgcggaagacggactggctccccatgaccgtggccgccatgggggtgccgcccctcccgctgttcatcttctccctcaaggacaccctgaagcgccgcagctggcccctgaacgagggcgtgatggccgtggggctcgtctccatcctggcgagctccctgctccggaacgacgtgcccatggccggccccctggtggccggcgggctgctcatcgcctgctacgtcatcaccggcacgagcgccgacctgaccgtggagaaggcggccgacgtgacctgggaggaggaggccgagcagaccggggtctcccacaacctgatgatcaccgtggacgacgacggcacgatgcgcatcaaggacgacgagaccgagaacatcctcaccgtgctgctgaagaccgccctcctgatcgtcagcgggatcttcccgtactccatccccgccacgctgctcgtgtggcacacctggcagaagcagacccagcggagcggcgtgctgtgggacgtccccagcccgcccgagacccagaaggcggagctggaggagggcgtgtaccgcatcaagcagcaggggatcctcggcaagacccaggtgggggtcggcgtgcagaaggagggggtgttccacaccatgtggcacgtcacccggggcgccgtgctgacccacaacggcaagcgcctggagcccaactgggccagcgtgaagaaggacctcatctcctacgggggcgggtggcggctgagcgcccagtggcagaagggcgaggaggtccaggtgatcgcggtggagcccgggaagaaccccaagaacttccagacgatgcccggcaccttccagaccaccacgggcgagatcggggccatcgccctggacttcaagcccggcacctccgggagccccatcatcaaccgcgagggcaaggtcgtgggcctgtacgggaacggcgtggtcaccaagaacgggggctacgtgagcgggatcgcccagaccaacgccgagccggacggccccacgcccgagctcgaggaggagatgttcaagaagcggaacctgaccatcatggacctgcaccccggctccgggaagacccgcaagtacctcccggcgatcgtgcgggaggccatcaagcgccggctgcgcaccctgatcctcgcccccacgcgggtcgtggccgccgagatggaggaggcgctgaagggcctgcccatccgctaccagaccaccgccaccaagagcgagcacacggggcgggagatcgtggacctcatgtgccacgccaccttcaccatgcgcctgctgtcccccgtccgggtgccgaactacaacctcatcatcatggacgaggcccacttcaccgaccccgccagcatcgcggcccgcggctacatctccacgcgggtggggatgggcgaggccgccgcgatcttcatgagcgccacgccgcccggcaccgccgacgccttcccgcagtccaacgcccccatccaggacgaggagcgcgacatccccgagcgcagctggaactccgggaacgagtggatcaccgacttcgcgggcaagacggtctggttcgtgcccagcatcaaggccgggaacgacatcgccaactgcctgcggaagaacggcaagaaggtgatccagctgtcccgcaagaccttcgacaccgagtaccagaagaccaagctcaacgactgggacttcgtcgtgacgaccgacatcagcgagatgggggccaacttcaaggccgaccgggtgatcgacccgcgccggtgcctgaagcccgtcatcctgaccgacggccccgagcgcgtgatcctcgcgggccccatgccggtgaccgccgcctccgccgcccagcggcgcgggcgggtcggccgcaacccccagaaggagaacgaccagtacatcttcaccgggcagcccctgaacaacgacgaggaccacgcgcactggacggaggccaagatgctgctcgacaacatcaacacccccgagggcatcatcccggccctgttcgagcccgagcgggagaagtccgccgcgatcgacggggagtaccgcctgaagggcgagtcccggaagaccttcgtggagctcatgcgccggggcgacctgcccgtgtggctggcccacaaggtcgccagcgaggggatcaagtacaccgaccgcaagtggtgcttcgacggccagcggaacaaccagatcctcgaggagaacatggacgtggagatctggacgaaggagggggagaagaagaagctgcgcccccggtggctggacgcccgcacctactccgacccgctcgccctgaaggagttcaaggacttcgcggccggccgcaagagcatcgccctggacctcgtcaccgagatcggccgggtgccctcccacctggcccaccgcacccggaacgccctggacaacctcgtgatgctgcacacgagcgagcacgggggccgcgcgtaccggcacgccgtcgaggagctgcccgagaccatggagaccctcctgctgctcgggctgatgatcctgctcaccggcggggccatgctgttcctgatcagcggcaagggcatcgggaagacgtccatcggcctcatctgcgtgatcgccagctccgggatgctgtggatggccgagatcccgctgcagtggatcgcgagcgccatcgtgctcgagttcttcatgatggtcctgctgatccccgagcccgagaagcagcgcacgccccaggacaaccagctcgcctacgtggtgatcggcatcctgaccctggccgccatcatcgcggccaacgagatggggctcctggagaccacgaagcgggacctgggcatgtccaaggagccgggcgtcgtgagccccacctcctacctcgacgtggacctgcaccccgccagcgcctggaccctgtacgcggtcgccaccacggtgatcacccccatgctccgccacaccatcgagaactccaccgccaacgtgagcctggccgccatcgcgaaccaggccgtcgtgctgatggggctcgacaagggctggccgatctccaagatggacctgggggtgcccctgctcgccctgggctgctacagccaggtcaaccccctgacgctcaccgccgccgtgctgctgctcatcacccactacgcgatcatcgggcccggcctgcaggccaaggccacccgggaggcccagaagcgcacggccgcgggcatcatgaagaacccgaccgtggacgggatcatcaccatcgacctggaccccgtcatctacgactccaagttcgagaagcagctcggccaggtgatgctgctggtgctctgcgccgtccagctgctgctcatgcggaccagctgggccctgtgcgaggccctgacgctcgcgaccgggcccatcaccaccctgtgggagggctcccccggcaagttctggaacacgaccatcgccgtgagcatggccaacatcttccgcgggtcctacctggccggcgccgggctcgcgttcagcatcatgaagtccgtgggcaccgggaagcggggcaccggcagccagggggagaccctgggcgagaagtggaagaagaagctgaaccagctcagccgcaaggagttcgacctgtacaagaagtccgggatcacggaggtcgaccggaccgaggccaaggagggcctgaagcgcggggagaccacccaccacgccgtgagccggggctccgccaagctccagtggctggtggagcgcaacatggtcatcccggagggccgggtgatcgacctggggtgcggccgcgggggctggagctactactgcgccgggctcaagaaggtgacggaggtccggggctacaccaagggcgggcccggccacgaggagcccgtgcccatgtccacctacgggtggaacatcgtgaagctgatgagcggcaaggacgtcttctacctgccgcccgagaagtgcgacaccctgctctgcgacatcggggagtccagcccctcccccacggtggaggagagccgcaccatccgcgtgctgaagatggtcgagccgtggctgaagaacaaccagttctgcatcaaggtgctcaacccctacatgcccgcggtgatcgagcacctggagcggctgcagcgcaagcacggcggcatgctcgtccggaaccccctgtcccgcaacagcacccacgagatgtactggatctccaacgggaccggcaacatcgtgagctccgtgaacatggtcagccggctgctcctgaaccgcttcacgatgacccaccggcgcccgaccatcgagaaggacgtggacctgggggccggcacccggcacgtgaacgccgagcccgagacgcccaacatggacgtcatcggcgagcgcatcaagcggatcaaggaggagcacaactccacctggcactacgacgacgagaacccgtacaagacctgggcctaccacgggagctacgaggtgaaggccaccggctccgcgagcagcatgatcaacggggtggtcaagctcctgacgaagccctgggacgtggtccccatggtgacccagatggccatgaccgacaccacgcccttcggccagcagcgcgtgttcaaggagaaggtcgacacccggaccccgcgccccatgcccgggacccggaaggtgatggagatcacggccgagtggctgtggcgcaccctcggccggaacaagcgcccccggctgtgcacccgcgaggagttcaccaagaaggtgcgcacgaacgccgcgatgggcgccgtcttcaccgaggagaaccagtgggactccgccaaggccgccgtggaggacgaggagttctggaagctggtggaccgggagcgcgagctccacaagctggggaagtgcggcagctgcgtctacaacatgatggggaagcgggagaagaagctgggcgagttcgggaaggcgaagggctcccgcgccatctggtacatgtggctcggcagccggtacctggagttcgaggccctggggttcctcaacgaggaccactggttctcccgcgagaacagctactccggcgtggagggggagggcctgcacaagctggggtacatcctccgggacatcagcaagatcccgggcggcgccatgtacgccgacgacaccgcggggtgggacacccgcatcacggaggacgacctgcacaacgaggagaagatcacccagcagatggaccccgagcaccggctgctcgccaacgccatcttcaagctgacctaccagaacaaggtggtcaaggtgcagcgccccacccccaccggcacggtgatggacatcatctcccggaaggaccagcgcgggagcggccaggtcggcacctacgggctgaacaccttcaccaacatggaggcccagctcgtgcggcagatggagggcgagggggtgctgtccaaggccgacctggagaacccgcacctccccgagaagaagatcacgcagtggctggagaccaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccgtccaagggctggcacgactggcagcaggtccccttctgcagccaccacttccacgagctcatcatgaaggacgggcgcaagctggtggtcccctgccggccccaggacgagctgatcggccgcgcccggatctcccagggggcgggctggagcctccgcgagaccgcctgcctggggaaggcctacgcccagatgtggtccctgatgtacttccaccgccgggacctccgcctggcgagcaacgccatctgctccgccgtgccggtgcactgggtccccaccagccggacgacctggagcatccacgcccaccaccagtggatgaccaccgaggacatgctgacggtgtggaaccgcgtgtggatcgaggacaacccctggatggaggacaagacccccgtcaccacctgggagaacgtgccgtacctcggcaagcgggaggaccagtggtgcggctccctgatcgggctgacgagccgcgccacctgggcgcagaacatccccaccgccatccagcaggtccggtccctcatcggcaacgaggagttcctggactacatgcccagcatgaagcgcttccggaaggaggaggagtccgagggggccatctggtga

SEQ ID NO: 9873 - RNA, 9873 nt, synthetic construct
  misc_feature 1..9873: note = derived and/or modified CDS sequence (opt1) from DENV-3__FJ898462__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcgcacggcgaccctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcgtgttcccgtacagcatccccgcgaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcgcagtggcagcgcggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctcaccatcatggacctgcaccccgggagcggcaagacccggaagtacctgccggccatcgtccgcgaggccatcaagcggcgcctccggacgctgatcctggcccccacccgcgtggtggccgcggagatggaggaggccctcaaggggctgcccatccggtaccagaccaccgccacgaagtccgagcacaccggccgcgagatcgtcgacctgatgtgccacgccaccttcaccatgcggctcctgagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctccgcaagaacgggaagaaggtcatccagctgtcccggaagaccttcgacacggagtaccagaagaccaagctgaacgactgggacttcgtggtgaccaccgacatcagcgagatgggcgccaacttcaaggcggaccgcgtcatcgacccgcggcgctgcctcaagcccgtgatcctgacggacggccccgagcgggtgatcctggccgggcccatgccggtcaccgccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagacgttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacctactccgacccgctggcgctcaaggagttcaaggacttcgccgccggccgcaagagcatcgccctggacctggtgacggagatcgggcgcgtgccctcccacctcgcccaccggacccgcaacgcgctggacaacctggtcatgctccacaccagcgagcacggcgggcgggcctaccgccacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcacgctggccgcgatcatcgccgccaacgagatgggcctgctcgagaccaccaagcgcgacctgggcatgtccaaggagccgggggtggtgagccccacctcctacctggacgtcgacctccaccccgccagcgcgtggacgctgtacgccgtggccaccaccgtgatcacccccatgctgcggcacacgatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacgcactacgccatcatcggccccggcctccaggccaaggccacccgcgaggcccagaagcggaccgcggccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcgcaccagctgggccctctgcgaggcgctgaccctggccaccggccccatcacgaccctctgggagggctcccccgggaagttctggaacaccaccatcgccgtgagcatggccaacatcttccggggctcctacctggccggggcgggcctggccttcagcatcatgaagtccgtcgggacgggcaagcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagacgacccaccacgccgtgagccgcggctccgccaagctgcagtggttcgtcgagcggaacatggtgatcccggaggggcgcgtgatcgacctcggctgcgggcggggcgggtggagctactactgcgcgggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccatcgtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgccgagtggctctggcgcaccctggggcggaacaagaagccccgcctgtgcacgcgcgaggagttcaccaagaaggtccggaccaacgcggccatgggcgccgtgttcaccgaggagaaccagtgggactccgccaaggccgcggtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgcgatgtacgccgacgacacggccgggtgggacacccggatcaccgaggacgacctgcacaacgaggagaagatcacccagcagatggacccggagcaccgccagctcgccaacgccatcttcaagctgacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcgcagctcatccgccagatggagggcgagggggtgctgagcaaggccgacctggagaacccccacctcccggagaagaagatcacccagtggctggagaccaagggcgtcgagcggctgaagcgcatggccatctccggcgacgactgcgtggtgaagcccatcgacgaccggttcgccaacgccctcctggcgctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctccgcgagacggcctgcctgggcaaggcgtacgcccagatgtggagcctgatgtacttccaccggcgcgacctccggctggcctccaacgccatctgcagcgccgtgcccgtgcactgggtcccgacctcccgcaccacctggagcatccacgcgcaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggccacctgggcccagaacatcccgacggccatccagcaggtccgcagcctcatcggcaacgaggagttcctggactacatgccctccatgaagcggttccgcaaggaggaggagagcgagggggccatctggtga

SEQ ID NO: 9874 - RNA, 9873 nt, synthetic construct
  misc_feature 1..9873: note = derived and/or modified CDS sequence (opt1) from DENV-3__KF955473__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgatcctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggccagcacgaccgaggcgatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgccaagaagcaggaggtcgtggtgctggggtcccaggagggcgcgatgcacaccgccctcaccggggccacggagatccagaacagcggcgggacctccatcttcgccggccacctgaagtgccggctgaagatggacaagctcgagctgaagggcatgagctacgccatgtgcaccaacaccttcgtcctgaagaaggaggtgtccgagacgcagcacgggaccatcctcatcaaggtggagtacaagggcgaggacgcgccgtgcaagatccccttcagcaccgaggacgggcagggcaaggcccacaacggccgcctgatcaccgccaaccccgtcgtgacgaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacgtggaccgagcagtacaagttccaggccgactcccccaagcgcctcgccaccgccatcgccggcgcgtgggagaacggggtctgcggcatccgcagcaccacgcggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacgtgggggaaggccaagatcgtgaccgccgagacccagaacagctccttcatcatcgacggccccaacacccccgagtgccccagcgcgtcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcacgttcgtgctgctcctgtccggccagatcacctggcgcgacatggcccacaccctgatcatgatcggcagcaacgcctccgaccggatggggatgggcgtcacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatgttcaccctgaccgtggcctggcgcaccgcgacgctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcaccgggacgtccgcggacctgaccgtggagaaggccgccgacatcacctgggaggaggaggccgagcagaccggcgtcagccacaacctgatgatcacggtggacgacgacgggaccatgcgcatcaaggacgacgagaccgagaacatcctcaccgtgctgctgaagaccgccctcctgatcgtctccggcgtgttcccgtacagcatccccgcgacgctgctcgtgtggcacacctggcagaagcagacccagcggtccggcgtcctgtgggacgtgcccagcccgcccgagacccagaaggccgagctggaggagggggtgtaccgcatcaagcagcagggcatcttcgggaagacgcaggtcggcgtgggggtgcagaaggagggcgtcttccacaccatgtggcacgtgacccggggcgccgtgctcacctacaacgggaagcgcctggagcccaactgggcctccgtcaagaaggacctgatcagctacggcgggggctggcggctctccgcgcagtggcagaagggggaggaggtccaggtgatcgccgtcgagcccggcaagaaccccaagaacttccagacgatgcccggcaccttccagaccaccacgggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagaccaacgcggagccggacggccccacgcccgagctggaggaggagatgttcaagaagcggaacctcaccatcatggacctgcaccccgggagcggcaagacccgcaagtacctgccggccatcgtccgggaggccatcaagcgccggctccgcaccctgatcctggcccccacgcgggtggtggccgcggagatggaggaggccctcaaggggctgcccatccgctaccagaccaccgccaccaagtccgagcacacgggccgggagatcgtcgacctgatgtgccacgccaccttcaccatgcgcctcctgagccccgtgcgggtgccgaactacaacctgatcatcatggacgaggcccacttcaccgaccccgcgtccatcgccgcccgcgggtacatcagcacgcgggtcggcatgggcgaggccgcggccatcttcatgaccgccacgccgcccgggaccgccgacgccttcccgcagtccaacgcgcccatccaggacgaggagcgcgacatccccgagcgcagctggaactccggcaacgagtggatcacggacttcgccgggaagaccgtgtggttcgtgcccagcatcaaggccggcaacgacatcgccaactgcctccggaagaacgggaagaaggtcatccagctgtcccgcaagaccttcgacaccgagtaccagaagacgaagctgaacgactgggacttcgtggtgaccaccgacatcagcgagatgggcgccaacttcaaggcggaccgggtcatcgacccgcgccggtgcctcaagcccgtgatcctgaccgacggccccgagcgcgtgatcctggccgggcccatgccggtcacggccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagaccttcgtggagctgatgcgccgcggggacctccccgtctggctggcccacaaggtggccagcgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggcgctcaaggagttcaaggacttcgccgccggccgcaagagcatcgccctggacctggtgaccgagatcgggcgggtgccctcccacctcgcccaccgcacgcggaacgcgctggacaacctggtcatgctccacaccagcgagcacggcgggcgcgcctaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcgcacgccccaggacaaccagctggcctacgtggtcatcgggatcctcaccctggccgcgatcatcgccgccaacgagatgggcctgctcgagacgaccaagcgggacctgggcatgtccaaggagccgggggtggtgagccccacctcctacctggacgtcgacctccaccccgccagcgcgtggaccctgtacgccgtggccacgaccgtgatcacccccatgctgcgccacaccatcgagaactccacggccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacccactacgccatcatcggccccggcctccaggccaaggccacgcgggaggcccagaagcgcaccgcggccgggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcggacgagctgggccctctgcgaggcgctgaccctggccaccggccccatcaccacgctctgggagggctcccccgggaagttctggaacaccaccatcgccgtgagcatggccaacatcttccgcggctcctacctggccggggcgggcctggccttcagcatcatgaagtccgtcgggaccggcaagcggggcacggggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagaccacgcaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgccgagtggctctggcggaccctggggcgcaacaagaagccccggctgtgcacgcgcgaggagttcaccaagaaggtccgcaccaacgcggccatgggcgccgtgttcaccgaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcgcagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggcgctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctccgcgagacggcctgcctgggcaaggcgtacgcccagatgtggagcctgatgtacttccaccgccgggacctccgcctggcctccaacgccatctgcagcgccgtgcccgtgcactgggtcccgacctcccggaccacctggagcatccacgcgcaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggcagcctgatcgggctgacctcccgcgccacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 9875 - RNA, 9873 nt, synthetic construct
  misc_feature 1..9873: note = derived and/or modified CDS sequence (opt1) from DENV-3__FJ850079__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacgtggaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcaccggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacgtgcacctggccgaagtcccacaccctctggagcaacggcgtcctggagtccgacatgatcatccccaagagcctggccgggcccatctcccagcacaactaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtcgacaacttcaccatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtcggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtggcctggcgcaccgccaccctgatcctcgcgggggtcagcctgctgccggtgtgccagtccagctccatgcggaagaccgactggctccccatgacggtggccgccatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgacggtggagaaggccgcggacgtgacctgggaggaggaggccgagcagaccggcgtcagccacaacctgatgatcaccgtggacgacgacgggaccatgcgcatcaaggacgacgagacggagaacatcctcaccgtgctgctgaagaccgccctcctgatcgtctccggcatcttcccgtacagcatccccgccaccctgctcgtgtggcacacgtggcagaagcagacccagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacacgatgtggcacgtcacccggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtcgtggggctgtacggcaacggggtggtcaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtcgtggccgccgagatggaggaggccctcaaggggctgcccatccgctaccagacgaccgcgaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtctggttcgtgcccagcatcaaggcgggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtcaccgagatcgggcgggtgcccacccacctcgcccaccgcacgcggaacgccctggacaacctggtgatgctccacacctccgagcacggcgggaaggcctaccgccacgcggtcgaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagacgaccaagcgcgacctgggcatgagcaaggagccgggggtcgtgtcccccaccagctacctggacgtggacctccaccccgcctccgcctggaccctgtacgccgtcgcgacgaccgtgatcacccccatgctgcggcacaccatcgagaacagcacggccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgaccctgaccgccgccgtgctcctgctgatcacccactacgccatcatcggccccggcctccaggcgaaggccacgcgcgaggcccagaagcggaccgccgccgggatcatgaagaacccgaccgtggacggcatcatgaccatcgacctggaccccgtcatctacgacagcaagttcgagaagcagctgggccaggtgatgctcctggtgctgtgcgcggtccagctcctgctgatgcgcacgtcctgggccctctgcgaggccctgaccctggccaccggccccatcaccacgctctgggagggcagccccgggaagttctggaacaccaccatcgcggtgtccatggccaacatcttccggggcagctacctggccggggccggcctggccttctccatcatgaagtccgtggggaccggcaagcgcggcaccgggtcccagggcgagacgctcggggagaagtggaagaagaagctgaaccagctgagccggaaggagttcgacctctacaagaagtccggcatcaccgaggtcgaccgcaccgaggcgaaggaggggctgaagcggggcgagatcacccaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgacggaggtccgcggctacaccaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccacggtggaggagtcccggaccatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcacggggaacatcgtggcctccgtgaacatggtcagccgcctcctgctgaaccggttcaccatgacccaccgccggccgaccatcgagaaggacgtggacctcggcgcgggcacgcgccacgtgaacgccgagcccgagacccccaacatggacgtcatcggggagcggatcaagcgcatcaaggaggagcacgactccacctggcactacgacgacgagaacccgtacaagacctgggcctaccacggcagctacgaggtgaaggccacggggtccgccagctccatgatcaacggcgtcgtgaagctgctgaccaagccctgggacgtggtccccatggtgacccagatggcgatgaccgacacgacccccttcgggcagcagcgggtgttcaaggagaaggtcgacacccgcaccccgcggagcatgcccggcacgcgccgggtgatgggcatcaccgccgagtggctctggcgcaccctggggcggaacaagaagccccgcctgtgcacccgggaggagttcacgaagaaggtgcgcaccaacgccgccatgggcgcggtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtggtcaaggtgcagcggcccacccccacgggcaccgtgatggacatcatctcccgcaaggaccagcggggcagcgggcaggtcggcacctacgggctgaacaccttcacgaacatggaggcccagctcatccgccagatggagggcgagggggtgctgtccaaggccgacctggagaacccccacctcccggagaagaagatcacccagtggctggagaccaagggcgtggagcggctgaagcgcatggcgatcagcggcgacgactgcgtcgtgaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtccccgtgcactgggtgccgacgagccgcaccacctggtccatccacgcccaccaccagtggatgaccacggaggacatgctgaccgtctggaaccgggtgtggatcgaggacaacccctggatggaggacaagacccccgtgaccacgtgggagaacgtcccctacctcgggaagcgcgaggaccagtggtgcggcagcctgatcgggctgaccagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 9876 - RNA, 9873 nt, synthetic construct
  misc_feature 1..9873: note = derived and/or modified CDS sequence (opt1) from DENV-3__FJ850080__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggacgagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcaggtcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgcgatcctgttcgaggaggtgatgcgggggaagttcggcaagaagcacatgatcgccggggtgttcttcatgttcgtcctgctcctgtccggccagatcacctggcgcgacatggcccacaccctgatcatgatcggcagcaacgcctccgaccggatggggatgggcgtgacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatgttcaccctgaccgtcgcctggcgcaccgcgacgctgatcctcgccggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggcggtgggcctcgtgagcatcctggcctccagcctgctccggaacgacgtccccatggccggccccctggtggccgggggcctgctcatcgcctgctacgtgatcaccgggacgtccgcggacctgaccgtcgagaaggccgccgacatcacctgggaggaggaggccgagcagaccggcgtgagccacaacctgatgatcacggtggacgacgacgggaccatgcgcatcaaggacgacgagaccgagaacatcctcaccgtcctgctgaagaccgccctcctgatcgtgtccggcgtgttcccgtacagcatccccgcgacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggcctccgtgaagaaggacctgatcagctacggcgggggctggcggctctccgcgcagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagaccaacgcggagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtggtcgccgcggagatggaggaggccctcaaggggctgcccatccgctaccagaccaccgccaccaagtccgagcacacgggccgggagatcgtggacctgatgtgccacgccaccttcaccatgcgcctcctgagccccgtgcgggtcccgaactacaacctgatcatcatggacgaggcccacttcaccgaccccgcgtccatcgccgcccgcgggtacatcagcacgcgggtgggcatgggcgaggccgcggccatcttcatgaccgccacgccgcccgggaccgccgacgccttcccgcagtccaacgcgcccatccaggacgaggagcgcgacatccccgagcgcagctggaactccggcaacgagtggatcacggacttcgccgggaagaccgtgtggttcgtccccagcatcaaggccggcaacgacatcgccaactgcctccggaagaacgggaagaaggtgatccagctgtcccgcaagaccttcgacaccgagtaccagaagacgaagctgaacgactgggacttcgtggtcaccaccgacatcagcgagatgggcgccaacttcaaggcggaccgggtgatcgacccgcgccggtgcctcaagcccgtgatcctgaccgacggccccgagcgcgtcatcctggccgggcccatgccggtgacggccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagaccttcgtcgagctgatgcgccgcggggacctccccgtgtggctggcccacaaggtcgccagcgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtgaccgagatcgggcgggtcccctcccacctcgcccaccgcacgcggaacgcgctggacaacctggtgatgctccacaccagcgagcacggcgggcgcgcctaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcgcacgccccaggacaaccagctggcctacgtcgtgatcgggatcctcaccctggccgcgatcatcgccgccaacgagatgggcctgctcgagacgaccaagcgggacctgggcatgtccaaggagccgggggtggtcagccccacctcctacctggacgtggacctccaccccgccagcgcgtggaccctgtacgccgtggccacgaccgtcatcacccccatgctgcgccacaccatcgagaactccacggccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacccactacgccatcatcggccccggcctccaggccaaggccacgcgggaggcccagaagcgcaccgcggccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcggacgagctgggccctctgcgaggcgctgaccctggccaccggccccatcaccacgctctgggagggctcccccgggaagttctggaacaccaccatcgccgtcagcatggccaacatcttccgcggctcctacctggccggggcgggcctggccttcagcatcatgaagtccgtggggaccggcaagcggggcacggggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagaccacgcaccacgccgtcagccggggctccgccaagctgcagtggttcgtggagcgcaacatggtgatcccggaggggcgggtcatcgacctcggctgcgggcgcggcgggtggagctactactgcgcgggcctgaagaaggtgaccgaggtgcggggctacaccaagggcggccccgggcacgaggagcccgtccccatgtccacctacggctggaacatcatcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaagatcctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggccagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggactccgccaaggccgcggtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcgcagctcatccggcagatggagggcgagggggtgctgagcaaggccgacctggagaacccccacctcccggagaagaagatcacccagtggctggagaccaagggcgtggagcgcctgaagcggatggccatctccggcgacgactgcgtcgtgaagcccatcgacgaccgcttcgccaacgccctcctggcgctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagacggcctgcctgggcaaggcgtacgcccagatgtggagcctgatgtacttccaccgccgggacctccgcctggcctccaacgccatctgcagcgccgtccccgtgcactgggtgccgacctcccggaccacctggagcatccacgcgcaccaccagtggatgacgaccgaggacatgctgaccgtctggaaccgcgtgtggatcgaggacaacccctggatggaggacaagacccccgtgacgacctgggaggacgtcccctacctcgggaagcgggaggaccagtggtgcggcagcctgatcgggctgacctcccgcgccacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 9877 - RNA, 9873 nt, synthetic construct
  misc_feature 1..9873: note = derived and/or modified CDS sequence (opt1) from DENV-3__FJ850083__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagcacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagcgcgaggtgtccgagacccagcacgggaccatcctcatcaaggtggagtacaagggcgaggacgcgccgtgcaagatccccttcagcaccgaggacgggcagggcaaggcccacaacggccggctgatcacggccaaccccgtcgtgaccaagaaggacgagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggaccatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccggagcaccacccgcatggagaacctgctgtggaagcagatcgccaacgagctcaactacatcctgtgggagaacaacatcaagctgaccgtggtggtcggggacatcatcggcgtgctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgcgtcccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatgttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcgtgttcccgtacagcatccccgcgaccctgctcgtgtggcacacctggcagaagcagacgcagcgctccggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagcccaactgggcctccgtcaagaaggacctgatcagctacggcgggggctggcgcctctccgcgcagtggcagaagggggaggaggtccaggtgatcgccgtcgagcccggcaagaaccccaagaacttccagaccatgcccggcaccttccagacgaccaccggggagatcggcgccatcgccctggacttcaagcccgggaccagcggcagccccatcatcaaccgggagggcaaggtggtggggctgtacggcaacggggtcgtgacgaagaacggcgggtacgtgtccggcatcgcccagaccaacgcggagccggacggccccacccccgagctggaggaggagatgttcaagaagcgcaacctcaccatcatggacctgcaccccgggagcggcaagacgcggaagtacctgccggccatcgtccgcgaggccatcaagcggcgcctccggaccctgatcctggcccccacccgcgtggtggccgcggagatggaggaggccctcaaggggctgcccatccggtaccagaccacggccaccaagtccgagcacaccggccgcgagatcgtcgacctgatgtgccacgccaccttcacgatgcggctcctgagccccgtgcgcgtgccgaactacaacctgatcatcatggacgaggcccacttcaccgaccccgcgtccatcgccgcccgggggtacatcagcacccgcgtcggcatgggcgaggccgcggccatcttcatgaccgccacgccgcccgggaccgccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctccgcaagaacgggaagaaggtcatccagctgtcccggaagacgttcgacaccgagtaccagaagaccaagctgaacgactgggacttcgtggtgaccacggacatcagcgagatgggcgccaacttcaaggcggaccgcgtcatcgacccgcggcgctgcctcaagcccgtgatcctgaccgacggccccgagcgggtgatcctggccgggcccatgccggtcaccgccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtactccgacccgctggcgctcaaggagttcaaggacttcgccgccggccgcaagagcatcgccctggacctggtgaccgagatcgggcgcgtgccctcccacctcgcccaccggacccgcaacgcgctggacaacctggtcatgctccacaccagcgagcacggcgggcgggcctaccgccacgccgtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcaccctggccgcgatcatcgccgccaacgagatgggcctgctcgagaccaccaagcgcgacctgggcatgtccaaggagccgggggtggtgagccccacgtcctacctggacgtcgacctccaccccgccagcgcgtggaccctgtacgccgtggccaccaccgtgatcacgcccatgctgcggcacaccatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgacggccgcggtgctcctgctgatcacccactacgccatcatcggccccggcctccaggccaaggccacccgcgaggcccagaagcggaccgcggccgggatcatgaagaacccgacggtcgacggcatcatgaccatcgacctggaccccgtgatctacgactccaagttcgagaagcagctgggccaggtgatgctcctggtcctgtgcgccgtgcagctcctgctgatgcgcaccagctgggccctctgcgaggcgctgaccctggccacgggccccatcaccaccctctgggagggctcccccgggaagttctggaacaccacgatcgccgtgagcatggccaacatcttccggggctcctacctggccggggcgggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcaccgaggtggaccgcacggaggccaaggaggggctgaagcggggcgagaccacccaccacgccgtgagccgcggctccgccaagctgcagtggttcgtcgagcggaacatggtgatcccggaggggcgcgtgatcgacctcggctgcgggcggggcgggtggagctactactgcgcgggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccgcacgatccgggtcctgaagatggtggagccgtggctcaagaacaaccagttctgcatcaagatcctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggcgaccgggagcgcctccagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgcggccatgggcgccgtcttcaccgaggagaaccagtgggactccgccaaggccgcggtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgcgatgtacgccgacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcgcagctcatccgccagatggagggcgagggggtgctgagcaaggccgacctggagaacccccacctcccggagaagaagatcacgcagtggctggagaccaagggcgtggagcggctgaagcgcatggccatctccggcgacgactgcgtcgtgaagcccatcgacgaccggttcgccaacgccctcctggcgctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctccgcgagaccgcctgcctgggcaaggcgtacgcccagatgtggagcctgatgtacttccaccggcgcgacctccggctggcctccaacgccatctgcagcgccgtccccgtgcactgggtgccgacctcccgcacgacctggagcatccacgcgcaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggcagcctgatcgggctgacgtcccgggccacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 9878 - RNA, 9873 nt, synthetic construct
  misc_feature 1..9873: note = derived and/or modified CDS sequence (opt1) from DENV-3__FJ850086__SS-prME
  source 1..9873: mol_type = other RNA
accagcctctgcctcatgatgatcctgcccgcggccctggcgttccacctcaccagccgggacggcgagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcgccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggacgagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagaccgtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgcggtggtgcaggccgacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgcgggcgcctgggagaacggggtctgcggcatccgcagcacgacccggatggagaacctgctgtggaagcaggtcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgcggagacccagaacagctccttcatcatcgacggccccaacacgcccgagtgccccagcgcctcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgcggtccacgccgacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgcgggcagcgggaaggtggacaacttcacgatgggcgtcctgtgcctcgccatcctgttcgaggaggtgatgcgggggaagttcggcaagaagcacatgatcgccggggtgttcttcatgttcgtcctgctcctgtccggccagatcacctggcgcgacatggcccacaccctgatcatgatcggcagcaacgcctccgaccggatggggatgggcgtgacctacctcgcgctgatcgccacgttcaagatccagcccttcctggccctcgggttcttcctgcgcaagctgaccagccgggagaacctcctgctgggcgtgggcctcgccatggcgaccaccctgcagctgcccgaggacatcgagcagatggccaacgggatcgccctcggcctgatggccctgaagctcatcacgcagttcgagacctaccagctgtggaccgccctgatcagcctgacctgctccaacacgatgttcaccctgaccgtcgcgtggcgcaccgccacgctgatcctcgccggggtgagcctgctgccggtctgccagtccagctccatgcggaagaccgactggctccccatggccgtggccgcgatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggccggccccctggtggccgggggcctgctcatcgcgtgctacgtgatcaccgggacgtccgccgacctgaccgtcgagaaggccgccgacatcacctgggaggaggaggccgagcagaccggcgtgagccacaacctgatgatcacggtggacgacgacgggaccatgcgcatcaaggacgacgagaccgagaacatcctcaccgtcctgctgaagaccgcgctcctgatcgtgtccggcgtgttcccgtacagcatccccgccacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcgcagaccaacgccgagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtggtcgcggccgagatggaggaggccctcaaggggctgcccatccgctaccagaccaccgccaccaagtccgagcacacgggccgggagatcgtggacctgatgtgccacgccaccttcaccatgcgcctcctgagccccgtgcgggtcccgaactacaacctgatcatcatggacgaggcgcacttcaccgaccccgcctccatcgccgcccgcgggtacatcagcacgcgggtgggcatgggcgaggcggccgccatcttcatgaccgccacgccgcccgggaccgccgacgcgttcccgcagtccaacgcccccatccaggacgaggagcgcgacatccccgagcgcagctggaactccggcaacgagtggatcacggacttcgccgggaagaccgtgtggttcgtccccagcatcaaggccggcaacgacatcgccaactgcctccggaagaacgggaagaaggtgatccagctgtcccgcaagaccttcgacaccgagtaccagaagacgaagctgaacgactgggacttcgtggtcaccaccgacatcagcgagatgggcgcgaacttcaaggccgaccgggtgatcgacccgcgccggtgcctcaagcccgtgatcctgaccgacggccccgagcgcgtcatcctggccgggcccatgccggtgacggccgcctccgcggcccagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcccacaaggtcgccagcgagggcatcaagtacacggaccgcaagtggtgcttcgacgggcagcggaacaaccagatcctggaggagaacatggacgtggagatctggaccaaggagggcgagaagaagaagctccgcccccggtggctggacgcgcgcacctactccgacccgctggccctcaaggagttcaaggacttcgccgccggccgcaagagcatcgccctggacctggtgaccgagatcgggcgggtcccctcccacctcgcgcaccgcacgcggaacgccctggacaacctggtgatgctccacaccagcgagcacggcgggcgcgcctaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgcgagctccggcatgctctggatggccgagatcccgctgcagtggatcgccagcgccatcgtgctggagttcttcatgatggtgctcctgatccccgagcccgagaagcagcgcacgccccaggacaaccagctggcctacgtcgtgatcgggatcctcaccctggcggccatcatcgccgccaacgagatgggcctgctcgagacgaccaagcgggacctgggcatgtccaaggagccgggggtggtcagccccacctcctacctggacgtggacctccaccccgcgagcgcctggaccctgtacgccgtggccacgaccgtcatcacccccatgctgcgccacaccatcgagaactccacggccaacgtgagcctcgcggccatcgccaaccaggccgtggtcctgatgggcctggacaaggggtggccgatctccaagatggacctcggcgtgcccctgctggccctcgggtgctacagccaggtgaaccccctgaccctgaccgcggccgtcctcctgctgatcacccactacgccatcatcggccccggcctccaggccaaggccacgcgggaggcgcagaagcgcaccgccgccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcggacgagctgggcgctctgcgaggccctgaccctggccaccggccccatcaccacgctctgggagggctcccccgggaagttctggaacaccaccatcgccgtcagcatggccaacatcttccgcggctcctacctggcgggggccggcctggccttcagcatcatgaagtccgtggggaccggcaagcggggcacggggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagaccacgcaccacgccgtcagccggggctccgcgaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcggccccgggcacgaggagcccgtccccatgtccacctacggctggaacatcatcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaagatcctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggccagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcgtaccacggctcctacgaggtgaaggccaccgggagcgcctccagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgcggagtggctctggcggaccctggggcgcaacaagaagccccggctgtgcacgcgcgaggagttcaccaagaaggtgcgcaccaacgccgccatgggcgccgtcttcaccgaggagaaccagtgggactccgccaaggcggccgtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcccggtacctggagttcgaggcgctcgggttcctgaacgaggaccactggttcagccgcgagaactcctacagcggcgtggagggggagggcctgcacaagctcggctacatcctgcgggacatctccaagatccccgggggcgccatgtacgccgacgacacggccgggtgggacacccgcatcaccgaggacgacctgcacaacgaggagaagatcacccagcagatggacccggagcaccggcagctcgccaacgcgatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcccagctcatccggcagatggagggcgagggggtgctgagcaaggccgacctggagaacccccacctcccggagaagaagatcacccagtggctggagaccaagggcgtggagcgcctgaagcggatggccatctccggcgacgactgcgtcgtgaagcccatcgacgaccgcttcgccaacgcgctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagacggcgtgcctgggcaaggcctacgcccagatgtggagcctgatgtacttccaccgccgggacctccgcctggcctccaacgccatctgcagcgcggtccccgtgcactgggtgccgacctcccggaccacctggagcatccacgcccaccaccagtggatgacgaccgaggacatgctgaccgtctggaaccgcgtgtggatcgaggacaacccctggatggaggacaagacccccgtgacgacctgggaggacgtcccctacctcgggaagcgggaggaccagtggtgcggcagcctgatcgggctgacctcccgcgccacctgggcccagaacatcccgacggccatccagcaggtccggagcctcatcggcaacgaggagttcctggactacatgccctccatgaagcgcttccggaaggaggaggagagcgagggggcgatctggtga

SEQ ID NO: 9879 - RNA, 9873 nt, synthetic construct
  misc_feature 1..9873: note = derived and/or modified CDS sequence (opt1) from DENV-3__FJ850089__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagcacgagaacctcaagtacaccgtgatcatcacggtccacaccggggaccagcaccaggtgggcaacgagacccagggggtcaccgccgagatcacgccccaggccagcaccaccgaggtgatcctgcccgagtacggcaccctggggctcgagtgctccccgcgcaccggcctggacttcaacgagatgatcctgctcacgatgaagaacaaggcgtggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgccatgcacaccgcgctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgccccgtgcaagatccccttcagcaccgaggacgggcagggcaaggcgcacaacggccgcctgatcacggccaaccccgtggtgaccaagaaggacgagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaaggtgggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatgttcaccctgaccgtggcctggcgcacggccaccctgatcctcgcgggggtcagcctgctgccggtgtgccagtccagctccatgcggaagaccgactggctccccatggccgtggccgccatgggcgtgccgcccctcccgctgttcatcttcagcctcaaggacaccctgaagcgccgctcctggcccctgaacgagggggtgatggccgtgggcctcgtcagcatcctggcgtccagcctgctccggaacgacgtgcccatggccggccccctggtggccgggggcctgctcatcgcctgctacgtcatcacggggacctccgccgacctgaccgtggagaaggcggccgacatcacctgggaggaggaggccgagcagacgggcgtgagccacaacctgatgatcaccgtcgacgacgacgggaccatgcgcatcaaggacgacgagaccgagaacatcctcaccgtgctgctgaagacggccctcctgatcgtgtccggcgtcttcccgtacagcatccccgccaccctgctcgtgtggcacacctggcagaagcagacccagcggtccggcgtgctgtgggacgtccccagcccgcccgagacgcagaaggcggagctggaggagggggtgtaccgcatcaagcagcagggcatcttcgggaagacccaggtgggcgtcggggtgcagaaggagggcgtgttccacaccatgtggcacgtcacccggggcgccgtgctcacgtacaacgggaagcgcctggagcccaactgggcctccgtgaagaaggacctgatcagctacggcgggggctggcggctctccgcccagtggcagaagggggaggaggtccagatcatcgcggtggagcccggcaagaaccccaagaacttccagaccatgcccggcaccttccagaccacgaccggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagacgaacgccgagccggacggccccacccccgagctggaggaggagatgttcaagaagcggaacctcaccatcatggacctgcaccccgggagcggcaagacccgcaagtacctgccggcgatcgtgcgggaggccatcaagcgccggctccgcacgctgatcctggcccccacccgggtggtcgccgccgagatggaggaggcgctcaaggggctgcccatccgctaccagaccaccgccacgaagtccgagcacaccggccgggagatcgtggacctgatgtgccacgccaccttcaccatgcgcctcctgagccccgtgcgggtcccgaactacaacctgatcatcatggacgaggcccacttcacggaccccgcctccatcgcggcccgcgggtacatcagcacccgggtgggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaaggccgaccgggtgatcgacccgcgccggtgcctcaagcccgtgatcctgacggacggccccgagcgcgtcatcctggcggggcccatgccggtgaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtcgagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgcggccggccgcaagagcatcgccctggacctggtgacggagatcgggcgggtcccctcccacctcgcccaccgcacccggaacgccctggacaacctggtgatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgcgagcgccatcgtgctggagttcttcatgatggtgctcctgatccccgagcccgagaagcagcgcacgccccaggacaaccagctggcctacgtcgtgatcgggatcctcacgctggccgccatcatcgcggccaacgagatgggcctgctcgagaccaccaagcgggacctgggcatgtccaaggagccgggggtggtcagccccacctcctacctggacgtggacctccaccccgccagcgcctggacgctgtacgcggtggccaccaccgtcatcacccccatgctgcgccacacgatcgagaactccaccgccaacgtgagcctcgccgccatcgcgaaccaggccgtggtcctgatgggcctggacaaggggtggccgatctccaagatggacctcggcgtgcccctgctggccctcgggtgctacagccaggtgaaccccctgaccctgaccgccgccgtcctcctgctgatcacgcactacgcgatcatcggccccggcctccaggccaaggccacccgggaggcccagaagcgcaccgccgcggggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcggaccagctgggccctctgcgaggccctgaccctggcgaccggccccatcacgaccctctgggagggctcccccgggaagttctggaacaccaccatcgccgtcagcatggccaacatcttccgcggctcctacctggccggggccggcctggcgttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagacgacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaagatcctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggcgagcgtcaacatggtgtcccggctcctgctgaaccgcttcaccatgacgcaccggcgcccgaccatcgagaaggacgtggacctcggcgccggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcgtccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgcgatgggcgccgtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggcggacctggagaacccccacctcccggagaagaagatcacccagtggctggagacgaagggcgtcgagcgcctgaagcggatggccatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcgcggatcagccagggggccggctggtccctccgcgagaccgcctgcctgggcaaggcctacgcgcagatgtggagcctgatgtacttccaccgccgggacctccgcctggcctccaacgccatctgcagcgccgtgcccgtgcactgggtcccgacctcccggaccacgtggagcatccacgcccaccaccagtggatgaccaccgaggacatgctgaccgtgtggaaccgcgtgtggatcgaggacaacccctggatggaggacaagacgcccgtcaccacctgggaggacgtgccctacctcgggaagcgggaggaccagtggtgcggcagcctgatcgggctgacctcccgcgcgacgtgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 9880 - RNA, 9873 nt, synthetic construct
  misc_feature 1..9873: note = derived and/or modified CDS sequence (opt1) from DENV-3__FJ850092__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagcacgagaacctcaagtacaccgtgatcatcacggtccacaccggggaccagcaccaggtgggcaacgagacccagggggtcaccgccgagatcacgccccaggccagcaccaccgaggtgatcctgcccgagtacggcaccctggggctcgagtgctccccgcgcaccggcctggacttcaacgagatgatcctgctcacgatgaagaacaaggcgtggatggtgcaccggcagtggttcttcgacctgcccctgccctggaccagcggcgtcaccaccgagacgcccacctggaaccgcaaggagctcctggtgaccttcaagaacgcccacgccaagaagcaggaggtggtcgtgctggggtcccaggagggcgccatgcacaccgccctcacgggggcgaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgccccgtgcaagatccccttcagcaccgaggacgggcagggcaaggcccacaacggccgcctgatcacggcgaaccccgtggtcaccaagaaggacgagcccgtgaacatcgaggccgagccgcccttcggggagagcaacatcgtgatcggcatcggggacaacgccctgaagatcaactggtacaagaagggctccagcatcgggaagatgttcgaggccaccgcgcggggcgcccgccggatggccatcctgggcgacaccgcctgggacttcgggtccgtcggcggggtgctcaacagcctgggcaagatggtgcaccagatcttcgggtccgcctacacggcgctgttcagcggcgtctcctgggtgatgaaggtgggcatcggggtcctcctgacctggatcggcctgaacagcaagaacacctccatgagcttctcctgcatcgccatcgggatcatcaccctctacctgggcgccgtggtgcaggccgacatggggtgcgtcatcaactggaagggcaaggagctgaagtgcggcagcgggatcttcgtgacgaacgaggtgcacacctggaccgagcagtacaagttccaggccgactcccccaagcgcctcgcgaccgccatcgccggcgcctgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggtctacacccagctgtgcgaccaccggctcatgagcgcggccgtgaaggacgagcgcgccgtgcacgccgacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgccatcctgttcgaggaggtcatgcgggggaagttcggcaagaagcacatgatcgccggggtgttcttcaccttcgtgctgctcctgtccggccagatcacctggcgcgacatggcgcacaccctgatcatgatcggcagcaacgcctccgaccggatggggatgggcgtcacgtacctcgccctgatcgccaccttcaagatccagcccttcctggccctcgggttcttcctgcgcaagctgaccagccgggagaacctcctgctgggcgtgggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatgttcaccctgaccgtcgcctggcgcacggccaccctgatcctcgccggggtgagcctgctgccggtgtgccagtccagctccatgcggaagaccgactggctccccatggcggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgatcgtggagaaggccgcggacatcacctgggaggaggaggccgagcagaccggcgtcagccacaacctgatgatcacggtggacgacgacgggaccatgcgcatcaaggacgacgagaccgagaacatcctcaccgtgctgctgaagaccgccctcctgatcgtctccggcgtgttcccgtacagcatccccgccacgctgctcgtgtggcacacctggcagaagcagacccagcggtccggcgtcctgtgggacgtgcccagcccgcccgagacccagaaggccgagctggaggagggggtgtaccgcatcaagcagcagggcatcttcgggaagacgcaggtcggcgtgggggtgcagaaggagggcgtcttccacaccatgtggcacgtgacccggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagacgatgcccggcaccttccagaccaccacgggggagatcggcgcgatcgccctggacttcaagcccgggaccagcggcagccccatcatcaaccgcgagggcaaggtggtggggctgtacggcaacggggtcgtgaccaagaacggcgggtacgtgtccggcatcgcccagaccaacgccgagccggacggccccacgcccgagctggaggaggagatgttcaagaagcggaacctcaccatcatggacctgcaccccgggagcggcaagacccgcaagtacctgccggccatcgtccgggaggcgatcaagcgccggctccgcaccctgatcctggcccccacgcgggtggtggccgccgagatggaggaggccctcaaggggctgcccatccgctaccagaccaccgcgaccaagtccgagcacacgggccgggagatcgtcgacctgatgtgccacgccaccttcaccatgcgcctcctgagccccgtgcgggtgccgaactacaacctgatcatcatggacgaggcccacttcaccgaccccgcctccatcgccgcgcgcgggtacatcagcacgcgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcacggacttcgccgggaagaccgtgtggttcgtgcccagcatcaaggcgggcaacgacatcgccaactgcctccggaagaacgggaagaaggtcatccagctgtcccgcaagaccttcgacaccgagtaccagaagacgaagctgaacgactgggacttcgtggtgaccaccgacatcagcgagatgggcgccaacttcaaggccgaccgggtcatcgacccgcgccggtgcctcaagcccgtgatcctgaccgacggccccgagcgcgtgatcctggccgggcccatgccggtcacggcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtggccagcgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtgccctcccacctcgcccaccgcacgcggaacgccctggacaacctggtcatgctccacaccagcgagcacggcgggcgcgcctaccggcacgcggtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagacgaccaagcgggacctgggcatgtccaaggagccgggggtggtgagccccacctcctacctggacgtcgacctccaccccgccagcgcctggaccctgtacgccgtggcgacgaccgtgatcacccccatgctgcgccacaccatcgagaactccacggccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgaccgccgccgtgctcctgctgatcacccactacgccatcatcggccccggcctccaggcgaaggccacgcgggaggcccagaagcgcaccgccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcggacgagctgggccctctgcgaggccctgaccctggccaccggccccatcaccacgctctgggagggctcccccgggaagttctggaacaccaccatcgcggtgagcatggccaacatcttccgcggctcctacctggccggggccggcctggccttcagcatcatgaagtccgtcgggaccggcaagcggggcacggggagccagggcgagaccctcggggagaagtggaagaagaagctgaaccagctgagccgcaaggagttcgacctctacaagaagtccggcatcaccgaggtggaccggaccgaggcgaaggaggggctgaagcgcggcgagaccacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaagatcctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggccagcgtgaacatggtctcccggctcctgctgaaccgcttcaccatgacccaccggcgcccgacgatcgagaaggacgtggacctcggcgcgggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtggtccccatggtgacccagatggcgatgacggacaccacccccttcgggcagcagcgcgtgttcaaggagaaggtcgacacccggacgccgcgcagcatgcccggcacccggcgcgtgatgggcatcaccgccgagtggctctggcggaccctggggcgcaacaagaagccccggctgtgcacgcgcgaggagttcaccaagaaggtgcgcaccaacgccgccatgggcgcggtcttcaccgaggagaaccagtgggactccgccaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacacggcggggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcccagctcatccggcagatggagggcgagggggtgctgagcaaggccgacctggagaacccccacctcccggagaagaagatcacccagtggctggagaccaagggcgtggagcgcctgaagcggatggcgatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggcgggctggtccctccgcgagacggcctgcctgggcaaggcctacgcccagatgtggagcctgatgtacttccaccgccgggacctccgcctggcgtccaacgccatctgcagcgccgtccccgtgcactgggtgccgacctcccggaccacctggagcatccacgcccaccaccagtggatgacgaccgaggacatgctgaccgtctggaaccgcgtgtggatcgaggacaacccctggatggaggacaagacccccgtgacgacctgggaggacgtcccctacctcgggaagcgggaggaccagtggtgcggcagcctgatcgggctgacctcccgcgccacctgggcgcagaacatcccgacggccatccagcaggtccggagcctcatcggcaacgaggagttcctggactacatgccctccatgaagcgcttccggaaggaggaggagagcgagggggccatctggtga

SEQ ID NO: 9881 - RNA, 9873 nt, synthetic construct
  misc_feature 1..9873: note = derived and/or modified CDS sequence (opt1) from DENV-3__FJ850094__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgggacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgggacgcccacctggaaccgcaaggagctcctggtgaccttcaagaacgcccacgccaagaagcaggaggtcgtggtgctgggctcccaggagggggcgatgcacaccgccctcacgggcgccaccgagatccagaacagcgggggcacctccatcttcgccggccacctgaagtgccggctgaagatggacaagctcgagctgaaggggatgagctacgccatgtgcaccaacacgttcgtcctgaagaaggaggtgtccgagacccagcacggcaccatcctcatcaaggtggagtacaagggggaggacgcgccgtgcaagatccccttcagcaccgaggacggccagggcaaggcccacaacgggcgcctgatcacggccaaccccgtcgtgaccaagaaggacgagcccgtgaacatcgaggccgagccgcccttcggcgagagcaacatcgtcatcgggatcggcgacaacgcgctgaagatcaactggtacaagaaggggtccagcatcggcaagatgttcgaggccaccgcccggggcgcccgccggatggccatcctgggggacaccgcgtgggacttcggctccgtcggcggggtgctcaacagcctggggaagatggtccaccagatcttcgggtccgcctacacggccctgttcagcggcgtgtcctgggtgatgaagatcgggatcggcgtcctcctgacctggatcgggctgaacagcaagaacacctccatgagcttctcctgcatcgccatcggcatcatcaccctctacctgggggccgtggtgcaggcggacatgggctgcgtcgtgaactggaagggcaaggagctgaagtgcgggagcggcatcttcgtgacgaacgaggtccacacctggaccgagcagtacaagttccaggccgactcccccaagcgcctcgccaccgccatcgccggggcgtgggagaacggcgtgtgcgggatccgcagcacgacccggatggagaacctgctgtggaagcagatcgccaacgagctcaactacatcctgtgggagaacaacatcaagctgaccgtggtcgtgggcgacaccatcggcgtgctcgagcaggggaagcgcacgctgacgccccagccgatggagctgaagtactcctggaagacctggggcaaggccaagatcgtcaccgccgagacgcagaacagctccttcatcatcgacgggcccaacacccccgagtgccccagcgcgtcccgggcctggaacgtgtgggaggtggaggactacggcttcggcgtcttcaccaccaacatctggctcaagctgcgcgaggtgtacacccagctgtgcgaccaccggctcatgagcgccgccgtgaaggacgagcgcgccgtccacgcggacatggggtactggatcgagagccagaagaacggctcctggaagctggagaaggccagcctgatcgaggtgaagacgtgcacctggccgaagtcccacaccctctggagcaacggggtgctggagtccgacatgatcatccccaagagcctggccggccccatctcccagcacaactaccggccggggtaccacacccagacggccggcccctggcacctcggcaagctggagctggacttcaactactgcgaggggaccaccgtcgtgatcaccgagaactgcggcacgcgcgggcccagcctccggaccaccaccgtgtccggcaagctgatccacgagtggtgctgccgcagctgcacgctgcccccgctccggtacatgggggaggacggctgctggtacggcatggagatccgccccatctccgagaaggaggagaacatggtcaagagcctggtgtccgccgggagcggcaaggtggacaacttcaccatgggggtcctgtgcctcgcgatcctgttcgaggaggtgatgcggggcaagttcgggaagaagcacatgatcgccggcgtgttcttcaccttcgtcctgctcctgtccggccagatcacctggcgcgacatggcccacacgctgatcatgatcgggagcaacgcctccgaccggatgggcatgggggtgacctacctcgccctgatcgcgaccttcaagatccagcccttcctggccctcggcttcttcctgcgcaagctgaccagccgggagaacctcctgctgggcgtggggctcgccatggccacgaccctgcagctgcccgaggacatcgagcagatggcgaacggcatcgccctcgggctgatggccctgaagctcatcacccagttcgagacctaccagctgtggacggccctgatcagcctgacctgctccaacaccatgttcaccctgacggtcgcctggcgcaccgcgaccctgatcctcgccggcgtgagcctgctgccggtctgccagtccagctccatgcggaagaccgactggctccccatggccgtggccgccatgggggtgccgcccctcccgctgttcatcttcagcctcaaggacacgttcaagcgccgctcctggcccctgaacgagggcgtcatggcggtgggcctggtgagcatcctcgcctccagcctgctgcggaacgacgtccccatggccgggcccctcgtggccggcgggctgctgatcgcctgctacgtgatcaccggcacctccgcggacctcaccgtcgagaaggccgccgacatcacgtgggaggaggaggccgagcagaccggggtgagccacaacctgatgatcaccgtggacgacgacggcaccatgcgcatcaaggacgacgagaccgagaacatcctgacggtcctcctgaagaccgccctgctcatcgtgtccggcgtgttcccgtacagcatccccgcgaccctgctggtctggcacacctggcagaagcagacgcagcggtccggggtgctctgggacgtgcccagcccgcccgagacccagaaggccgagctggaggagggcgtctaccgcatcaagcagcaggggatcttcggcaagacccaggtgggggtgggcgtccagaaggagggcgtgttccacaccatgtggcacgtgacgcgcggggccgtcctgacctacaacggcaagcgcctcgagcccaactgggcctccgtgaagaaggacctgatcagctacgggggcgggtggcggctgtccgcgcagtggcagaagggcgaggaggtgcaggtcatcgccgtggagcccggcaagaaccccaagaacttccagaccatgcccgggaccttccagacgaccaccggcgagatcggggccatcgccctcgacttcaagcccggcaccagcggcagccccatcatcaaccgcgaggggaaggtggtcggcctgtacgggaacggcgtggtgacgaagaacgggggctacgtctccggcatcgcccagaccaacgcggagccggacgggcccacccccgagctggaggaggagatgttcaagaagcggaacctgaccatcatggacctccaccccggcagcgggaagacgcgcaagtacctgccggccatcgtgcgggaggccatcaagcgccggctgcgcaccctcatcctggcccccacccgggtggtcgccgcggagatggaggaggccctgaagggcctccccatccgctaccagaccacggccaccaagtccgagcacaccgggcgggagatcgtggacctgatgtgccacgccaccttcacgatgcgcctgctcagccccgtgcgggtcccgaactacaacctgatcatcatggacgaggcccacttcaccgaccccgcgtccatcgccgcccgcggctacatcagcacccgggtgggcatgggggaggccgcggccatcttcatgaccgccacgccgcccggcaccgccgacgccttcccgcagtccaacgcgcccatccaggacgaggagcgcgacatccccgagcgcagctggaactccgggaacgagtggatcaccgacttcgccggcaagaccgtgtggttcgtccccagcatcaaggccgggaacggcatcgccaactgcctgcggaagaacggcaagaaggtgatccagctctcccgcaagacgttcgacaccgagtaccagaagaccaagctgaacgactgggacttcgtggtcaccacggacatcagcgagatgggggccaacttcaaggcggaccgggtgatcgacccgcgccggtgcctgaagcccgtgatcctcaccgacggccccgagcgcgtcatcctggccgggcccatgccggtgaccgccgcctccgccgcgcagcggcgcggccgggtggggcgcaacccccagaaggagaacgaccagtacatcttcaccggccagcccctgaacaacgacgaggaccacgcccactggaccgaggccaagatgctcctggacaacatcaacacgcccgagggcatcatcccggccctgttcgagcccgagcgggagaagtccgcggccatcgacggggagtaccgcctcaagggcgagtcccggaagaccttcgtcgagctgatgcgccgcggggacctgcccgtgtggctcgcccacaaggtcgccagcgagggcatcaagtacaccgaccgcaagtggtgcttcgacggccagcggaacaaccagatcctggaggagaacatggacgtggagatctggaccaaggagggggagaagaagaagctgcgcccccggtggctcgacgcccgcacgtactccgacccgctggcgctgaaggagttcaaggacttcgccgccggccgcaagagcatcgccctcgacctggtgaccgagatcgggcgggtcccctcccacctggcccaccgcacccggaacgcgctcgacaacctggtgatgctgcacaccagcgagcacggcgggcgcgcctaccggcacgccgtggaggagctccccgagacgatggagaccctgctgctcctgggcctgatgatcctcctgaccggcggggccatgctgttcctcatcagcggcaaggggatcggcaagacctccatcgggctgatctgcgtcatcgccagctccggcatgctgtggatggcggagatcccgctccagtggatcgccagcgccatcgtgctggagttcttcatgatggtgctgctcatccccgagcccgagaagcagcgcacgccccaggacaaccagctggcctacgtcgtgatcggcatcctgaccctcgccgcgatcatcgccgccaacgagatggggctgctggagaccaccaagcgggacctcggcatgtccaaggagccgggggtggtcagccccacgtcctacctggacgtggacctgcaccccgccagcgcgtggaccctctacgccgtggccaccaccgtcatcacgcccatgctgcgccacaccatcgagaactccaccgccaacgtgagcctggccgcgatcgccaaccaggccgtggtcctcatgggcctggacaaggggtggccgatctccaagatggacctgggcgtgcccctcctggccctgggctgctacagccaggtgaaccccctcaccctgacggccgcggtcctgctcctgatcacccactacgccatcatcgggcccggcctgcaggccaaggccacccgggaggcccagaagcgcaccgcggccgggatcatgaagaacccgacggtggacggcatcatgaccatcgacctcgaccccgtgatctacgactccaagttcgagaagcagctgggccaggtcatgctgctcgtgctgtgcgccgtgcagctgctcctgatgcggaccagctgggccctgtgcgaggcgctcaccctggccacggggcccatcaccaccctgtgggagggctcccccgggaagttctggaacaccacgatcgccgtcagcatggccaacatcttccgcggctcctacctcgccggggcgggcctggccttcagcatcatgaagtccgtgggcaccgggaagcggggcaccgggagccagggcgagaccctgggggagaagtggaagaagaagctcaaccagctgagccgcaaggagttcgacctgtacaagaagtccggcatcaccgaggtggaccggacggaggccaaggagggcctcaagcgcggggagaccacccaccacgccgtcagccggggctccgccaagctgcagtggttcgtggagcgcaacatggtgatcccggaggggcgggtcatcgacctgggctgcgggcgcggcggctggagctactactgcgcggggctcaagaaggtgaccgaggtgcggggctacacgaagggcgggcccgggcacgaggagcccgtccccatgtccacctacggctggaacatcgtgaagctgatgagcggcaaggacgtgttctacctgccgcccgagaagtgcgacaccctcctgtgcgacatcggggagtccagcccctcccccaccgtcgaggagagccgcacgatccgcgtgctgaagatggtggagccgtggctgaagaacaaccagttctgcatcaagatcctcaacccctacatgcccaccgtcatcgagcacctggagcggctgcagcgcaagcacggcgggatgctcgtgcggaaccccctgtcccgcaacagcacccacgagatgtactggatctccaacggcaccggcaacatcgtggccagcgtcaacatggtgtcccggctgctcctgaaccgcttcacgatgacccaccggcgcccgaccatcgagaaggacgtggacctgggggccggcacccggcacgtcaacgccgagcccgagacgcccaacatggacgtgatcggggagcgcatcaagcggatcaaggaggagcacaacagcacctggcactacgacgacgagaacccgtacaagacctgggcctaccacggctcctacgaggtgaaggcgaccgggagcgcctccagcatgatcaacggcgtcgtgaagctcctgacgaagccctgggacgtcgtgcccatggtgacccagatggccatgaccgacaccacgcccttcggccagcagcgcgtcttcaaggagaaggtggacacccggaccccgcgcagcatgcccgggacccggcgcgtgatgggcatcacggccgagtggctgtggcggaccctcgggcgcaacaagaagccccggctgtgcacccgcgaggagttcaccaagaaggtccgcacgaacgcggccatgggcgccgtgttcaccgaggagaaccagtgggactccgccaaggccgcggtggaggacgaggacttctggaagctggtcgaccgggagcgcgagctccacaagctggggaagtgcggcagctgcgtgtacaacatgatgggcaagcgggagaagaagctgggggagttcggcaaggccaaggggtcccgcgccatctggtacatgtggctcggcgcccggtacctggagttcgaggccctggggttcctcaacgaggaccactggttcagccgcgagaactcctacagcggcgtggagggcgaggggctgcacaagctgggctacatcctccgggacatctccaagatccccgggggcgcgatgtacgccgacgacaccgccggctgggacacccgcatcacggaggacgacctgcacaacgaggagaagatcacccagcagatggacccggagcaccggcagctggccaacgccatcttcaagctcacctaccagaacaaggtcgtgaaggtgcagcgccccacccccaccgggacggtcatggacatcatcagccggaaggaccagcgcggctccggccaggtgggcacctacgggctgaacaccttcaccaacatggaggcgcagctgatccggcagatggagggcgagggcgtgctcagcaaggccgacctggagaacccccacctccccgagaagaagatcacgcagtggctggagaccaagggggtcgagcgcctgaagcggatggccatctccggcgacgactgcgtggtgaagcccatcgacgaccgcttcgccaacgccctgctcgcgctgaacgacatggggaaggtccggaaggacatcccccagtggcagcccagcaagggctggcacgactggcagcaggtcccgttctgctcccaccacttccacgagctgatcatgaaggacgggcgcaagctcgtggtcccctgccggccccaggacgagctgatcggccgcgcccggatcagccagggcgccgggtggtccctgcgcgagaccgcctgcctcggcaaggcgtacgcccagatgtggagcctgatgtacttccaccgccgggacctgcgcctcgcctccaacgccatctgcagcgccgtgcccgtgcactgggtcccgacctcccggacgacctggagcatccacgcgcaccaccagtggatgaccaccgaggacatgctgacggtgtggaaccgcgtgtggatcgaggacaacccctggatggaggacaagacccccgtcaccacctgggaggacgtgccctacctggggaagcgggaggaccagtggtgcggcagcctcatcgggctgacgtcccgcgccacctgggcccagaacatcccgaccgccatccagcaggtccggagcctgatcggcaacgaggagttcctcgactacatgccctccatgaagcgcttccggaaggaggaggagagcgagggcgccatctggtga

SEQ ID NO: 9882 - RNA, 9873 nt, synthetic construct
  misc_feature 1..9873: note = derived and/or modified CDS sequence (opt1) from DENV-3__FJ898446__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagagcaacatcgtcatcggcaccggggacaacgcgctgaagatcaactggtacaagaagggctccagcatcgggaagatgttcgagaccacggcccgcggcgcccggcgcatggccatcctgggcgacaccgcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggccgacatggggtgcgtcatcaactggaagggcaaggagctgaagtgcggcagcgggatcttcgtgaccaacgaggtgcacacctggacggagcagtacaagttccaggcggactcccccaagcgcctcgccaccgccatcgccggcgcctgggagaacggggtctgcggcatccggagcaccacccgcatggagaacctgctgtggaagcagatcgcgaacgagctcaactacatcctgtgggagaacaacatcaagctgacggtggtggtcggggacatcatcggcgtgctcgagcagggcaagcggaccctgacgccccagccgatggagctgaagtactcctggaagacctgggggaaggccaagatcgtgacggccgagacccagaacagctccttcatcatcgacggccccaacacccccgagtgccccagcgcctcccgcgcgtggaacgtctgggaggtggaggactacgggttcggcgtgttcaccaccaacatctggctcaagctgcgggaggtctacacgcagctgtgcgaccaccgcctcatgagcgccgccgtgaaggacgagcgggccgtgcacgccgacatgggctactggatcgagagccagaagaacgggtcctggaagctggagaaggcgagcctgatcgaggtcaagacctgcacctggccgaagtcccacaccctctggagcaacggcgtgctggagtccgacatgatcatccccaagagcctggccgggcccatctcccagcacaaccaccgcccgggctaccacacgcagaccgccgggccctggcacctcggcaagctggagctggacttcaactactgcgagggcaccaccgtggtcatcacggagaactgcgggacccggggccccagcctccgcaccaccacggtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgccatcctgttcgaggaggtcatgcgcgggaagttcggcaagaagcacatgatcgcgggggtgttcttcaccttcgtgctgctcctgtccggccagatcacgtggcgggacatggcccacaccctgatcatgatcggcagcaacgcctccgaccgcatggggatgggcgtcacctacctcgccctgatcgccaccttcaagatccagcccttcctggcgctcgggttcttcctgcggaagctgacgagccgcgagaacctcctgctgggcgtgggcctcgccatggccaccaccctgcagctgcccgaggacatcgagcagatggccaacgggatcgcgctcggcctgatggccctgaagctcatcacccagttcgagacgtaccagctgtggaccgccctgatcagcctgacctgctccaacaccatgttcacgctgaccgtggcctggcggaccgccaccctgatcctcgcgggggtcagcctgctgccggtgtgccagtccagctccatgcgcaagacggactggctccccatggccgtcgccgccatgggcgtgccgcccctcccgctgttcatcttcagcctcaaggacaccctgaagcgccggtcctggcccctgaacgagggggtgatggccgtcggcctcgtgagcatcctggcgtccagcctgctccgcaacgacgtgcccatggccggccccctggtcgccgggggcctgctcatcgcctgctacgtgatcaccgggacctccgccgacctgacggtggagaaggcggccgacatcacctgggaggaggaggccgagcagaccggcgtcagccacaacctgatgatcaccgtggacgacgacgggaccatgcggatcaaggacgacgagacggagaacatcctcaccgtgctgctgaagaccgccctcctgatcgtctccggcgtgttcccgtacagcatccccgccaccctgctcgtgtggcacacgtggcagaagcagacccagcgctccggcgtcctgtgggacgtgcccagcccgcccgagacccagaaggcggagctggaggagggggtgtaccggatcaagcagcagggcatcttcgggaagacccaggtcggcgtgggggtgcagaaggagggcgtcttccacacgatgtggcacgtgacccgcggcgccgtgctcacctacaacgggaagcggctggagcccaactgggcctccgtcaagaaggacctgatcagctacggcgggggctggcgcctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgggagggcaaggtggtggggctgtacggcaacggggtcgtgaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtccgcgaggccatcaagcggcgcctccggaccctgatcctggcccccacccgcgtggtggccgccgagatggaggaggcgctcaaggggctgcccatccggtaccagacgaccgccaccaagtccgagcacaccggccgcgagatcgtcgacctgatgtgccacgccacgttcaccatgcggctcctgagccccgtgcgcgtgccgaactacaacctgatcatcatggacgaggcccacttcaccgaccccgcctccatcgcggcccgggggtacatcagcacccgcgtcggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtgtggttcgtgcccagcatcaaggccggcaacgacatcgccaactgcctccgcaagaacgggaagaaggtcatccagctgtcccggaagaccttcgacaccgagtaccagaagaccaagctgaacgactgggacttcgtggtgacgaccgacatcagcgagatgggcgccaacttcaaggccgaccgcgtcatcgacccgcggcgctgcctcaagcccgtgatcctgaccgacggccccgagcgggtgatcctggcggggcccatgccggtcaccgccgcctccgccgcccagcgccggggccgcgtggggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtcgagatctggacgaaggagggcgagaagaagaagctccggccccgctggctggacgcccgcacctactccgacccgctggccctcaaggagttcaaggacttcgcggccggccgcaagagcatcgccctggacctggtgaccgagatcgggcgcgtgccctcccacctcgcccaccggacccgcaacgccctggacaacctggtcatgctccacacgagcgagcacggcgggcgggcgtaccgccacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagaccacgaagcgcgacctgggcatgtccaaggagccgggggtggtgagccccacctcctacctggacgtcgacctccaccccgccagcgcctggaccctgtacgcggtggccaccacggtgatcacccccatgctgcggcacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgacgctgaccgccgccgtgctcctgctgatcacccactacgcgatcatcggccccggcctccaggccaaggccacccgcgaggcccagaagcggacggccgcggggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccgcacgatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggcgagcgtcaacatggtgtcccgcctcctgctgaaccggttcacgatgacccaccgccggccgaccatcgagaaggacgtggacctcggcgccggcacccgccacgtcaacgccgagcccgagacgcccaacatggacgtgatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtcgtgaagctgctgacgaagccctgggacgtcgtgcccatggtgacccagatggccatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgcgaggagttcaccaagaaggtccggacgaacgccgcgatgggcgccgtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatcagccgcaaggaccagcggggctccggccaggtgggcacctacgggctgaacaccttcaccaacatggaggcccagctcatccgccagatggagggcgagggggtgctgagcaaggcggacctggagaacccccacctcccggagaagaagatcacgcagtggctggagaccaagggcgtcgagcggctgaagcgcatggccatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtgcccgtgcactgggtcccgacctcccgcacgacctggagcatccacgcccaccaccagtggatgaccaccgaggacatgctgacggtgtggaaccgggtgtggatcgaggacaacccctggatggaggacaagacccccgtcaccacctgggagaacgtgccctacctcgggaagcgcgaggaccagtggtgcggcagcctgatcgggctgacgtcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 9883 - RNA, 9873 nt, synthetic construct
  misc_feature 1..9873: note = derived and/or modified CDS sequence (opt1) from DENV-3__GU131844__SS-prME
  source 1..9873: mol_type = other RNA
accagcctgtgcctgatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtcgagacgtgggccctgcggcaccccgggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgcccgaggagcaggaccagaactacgtctgcaagcacacctacgtggaccgcgggtggggcaacgggtgcggcctcttcgggaagggctccctggtgacctgcgccaagttccagtgcctggagctcatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctgcccgagtacggcaccctcgggctggagtgcagcccccggaccggcctggacttcaacgagatgatcctcctgacgatgaagaacaaggcctggatggtgcaccgccagtggttcttcgacctgccgctcccctggaccagcggcgccaccaccgagacgcccacctggaaccggaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccgcctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccctgcaagatcccgttcagcaccgaggacgggcagggcaaggcccacaacggccggctgatcacggccaaccccgtcgtgaccaagaaggaggagcccgtgaacatcgaggccgagcccccgttcggggagagcaacatcgtcatcggcaccggggacaacgcgctgaagatcaactggtacaagaagggctccagcatcgggaagatgttcgaggccaccgcccgcggcgcccggcgcatggccatcctcggcgacacggcgtgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcggacatggggtgcgtcatcaactggaagggcaaggagctcaagtgcggcagcgggatcttcgtgaccaacgaggtgcacacctggaccgagcagtacaagttccaggccgactcccccaagcgcctggccacggccatcgccggcgcgtgggagaacggggtctgcggcatccggagcaccacccgcatggagaacctgctctggaagcagatcgccaacgagctgaactacatcctgtgggagaacaacgtgaagctcaccgtggtcgtgggggacatcatcggcgtgctggagcagggcaagcggacgctgacgccccagcccatggagctcaagtactcctggaagacctgggggaaggccaagatcgtcaccgccgagacgcagaacagctccttcatcatcgacggcccgaacacccccgagtgccccagcgcgtcccgcgcctggaacgtgtgggaggtggaggactacgggttcggcgtcttcaccaccaacatctggctgaagctgcgggaggtgtacacccagctctgcgaccaccgcctgatgagcgccgccgtgaaggacgagcgggccgtccacgcggacatgggctactggatcgagagccagaagaacgggtcctggaagctggagaaggccagcctcatcgaggtgaagacgtgcacctggcccaagtcccacaccctgtggagcaacggcgtgctggagtccgacatgatcatccccaagtccctcgccgggcccatctcccagcacaaccaccgccccggctaccacacccagacggccgggccgtggcacctgggcaagctggagctcgacttcaactactgcgagggcaccaccgtcgtgatcaccgagaactgcgggacgcggggccccagcctgcgcaccaccaccgtgtccgggaagctgatccacgagtggtgctgccggagctgcacgctgccgcccctccgctacatgggcgaggacgggtgctggtacggcatggagatccggccgatctccgagaaggaggagaacatggtcaagagcctggtgtccgccggcagcgggaaggtggacaacttcaccatgggcgtcctctgcctggcgatcctgttcgaggaggtgatgcgcgggaagttcggcaagaagcacatgatcgccggggtgttcttcaccttcgtcctcctgctgtccggccagatcacctggcgggacatggcccacacgctcatcatgatcggcagcaacgcctccgaccgcatggggatgggcgtgacctacctggccctgatcgcgaccttcaagatccagcccttcctcgccctggggttcttcctgcggaagctcaccagccgcgagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatgttcaccctgacggtcgcctggcggaccgcgaccctcatcctggccggggtgagcctgctccccgtctgccagtccagctccatgcgcaagaccgactggctgccgatggccgtggccgccatgggcgtgccgcccctgcccctcttcatcttcagcctgaaggacacgctgaagcgccggtcctggccgctcaacgagggggtcatggcggtgggcctggtgagcatcctggcctccagcctcctgcgcaacgacgtccccatggccggccccctggtggccgggggcctcctgatcgcctgctacgtgatcaccgggacctccgcggacctgaccgtcgagaaggccgccgacatcacgtgggaggaggaggccgagcagaccggcgtgagccacaacctcatgatcaccgtggacgacgacgggaccatgcggatcaaggacgacgagaccgagaacatcctgacggtcctgctcaagaccgccctgctgatcgtgtccggcgtgttcccctacagcatcccggcgaccctcctggtctggcacacctggcagaagcagacgcagcgctccggcgtgctgtgggacgtgccctccccgcccgagacccagaaggccgagctcgaggagggggtctaccggatcaagcagcagggcatcttcgggaagacccaggtgggcgtgggggtccagaaggagggcgtgttccacaccatgtggcacgtgacgcgcggcgccgtcctgacctacaacgggaagcggctggagccgaactgggcctccgtgaagaaggacctcatcagctacggcgggggctggcgcctgtccgcgcagtggcagaagggggaggaggtgcaggtcatcgccgtggagcccggcaagaaccccaagaacttccagaccatgcccggcaccttccagacgaccaccggggagatcggcgccatcgccctggacttcaagccggggaccagcggcagccccatcatcaaccgggagggcaaggtggtcgggctgtacggcaacggggtggtgacgaagaacggcgggtacgtctccggcatcgcccagaccaacgcggagcccgacggcccgacccccgagctcgaggaggagatgttcaagaagcgcaacctgaccatcatggacctgcaccccgggagcggcaagacgcggaagtacctccccgccatcgtgcgcgaggccatcaagcggcgcctgcggaccctgatcctcgccccgacccgcgtggtcgccgcggagatggaggaggccctgaaggggctgcccatccggtaccagaccacggccaccaagtccgagcacaccggccgcgagatcgtggacctcatgtgccacgccaccttcacgatgcggctgctgagccccgtgcgcgtccccaactacaacctcatcatcatggacgaggcccacttcaccgacccggcgtccatcgccgcccgggggtacatcagcacccgcgtgggcatgggcgaggccgcggccatcttcatgaccgccacgccgcccgggaccgccgacgccttcccccagtccaacgcgccgatccaggacgaggagcgcgacatccccgagcggagctggaactccggcaacgagtggatcaccgacttcgccgggaagaccgtgtggttcgtccccagcatcaaggccggcaacgacatcgccaactgcctgcgcaagaacgggaagaaggtgatccagctgtcccggaagacgttcgacaccgagtaccagaagaccaagctcaacgactgggacttcgtggtcaccacggacatcagcgagatgggcgccaacttcaaggcggaccgcgtgatcgacccccggcgctgcctgaagccggtgatcctgaccgacggccccgagcgggtcatcctcgccgggcccatgcccgtgaccgccgcctccgccgcgcagcgccggggccgcgtggggcggaacccgcagaaggagaacgaccagtacatcttcaccggccagcccctgaacaacgacgaggaccacgcccactggaccgaggccaagatgctgctcgacaacatcaacacgcccgaggggatcatccccgccctgttcgagccggagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacaccgaccggaagtggtgcttcgacgggcagcgcaacaaccagatcctcgaggagaacatggacgtggagatctggaccaaggagggcgagaagaagaagctgcggccccgctggctggacgcccgcacgtactccgaccccctcgcgctgaaggagttcaaggacttcgccgccggccgcaagagcatcgccctggacctcgtgaccgagatcgggcgcgtcccgtcccacctggcccaccggacccgcaacgcgctggacaacctcgtgatgctgcacaccagcgagcacggcgggcgggcctaccgccacgccgtggaggagctgcccgagacgatggagaccctcctgctgctcggcctgatgatcctgctcaccgggggcgccatgctgttcctgatcagcggcaaggggatcggcaagacctccatcgggctcatctgcgtcatcgccagctccggcatgctgtggatggcggagatccccctgcagtggatcgccagcgccatcgtgctcgagttcttcatgatggtgctgctgatcccggagcccgagaagcagcggacgccccaggacaaccagctcgcctacgtcgtgatcgggatcctgaccctggccgcgatcatcgccgccaacgagatgggcctcctggagaccaccaagcgcgacctgggcatgtccaaggagcccggggtggtcagcccgacgtcctacctcgacgtggacctgcaccccgccagcgcgtggaccctgtacgccgtggccaccaccgtcatcacgcccatgctccggcacaccatcgagaactccaccgccaacgtgagcctggccgcgatcgccaaccaggccgtggtcctgatgggcctcgacaaggggtggcccatctccaagatggacctgggcgtgccgctgctcgccctggggtgctacagccaggtgaaccccctgaccctcacggccgcggtcctgctgctcatcacccactacgccatcatcggccccggcctgcaggccaaggccacccgcgaggcccagaagcggaccgcggccgggatcatgaagaaccccacggtggacggcatcatgaccatcgacctggacccggtgatctacgactccaagttcgagaagcagctcgggcaggtcatgctgctggtgctctgcgccgcccagctgctgctcatgcgcaccagctgggcgctgtgcgaggccctgaccctcgccacgggccccatcaccaccctgtgggagggctcccccgggaagttctggaacaccacgatcgccgtgagcatggccaacatcttccggggctcctacctggcgggggccggcctcgccttcagcatcatgaagtccgtcgggaccggcaagcgcggcaccgggagccagggcgagaccctgggggagaagtggaagaagaagctgaaccagctcagccggaaggagttcgacctgtacaagaagtccggcatcaccgaggtggaccgcacggaggccaaggaggggctgaagcggggcgagatcacccaccacgccgtgagccgcggctccgcgaagctccagtggttcgtcgagcggaacatggtgatccccgaggggcgcgtgatcgacctgggctgcgggcggggcgggtggagctactactgcgccggcctgaagaaggtcaccgaggtgcgcggctacaccaagggcgggccggggcacgaggagcccgtgcccatgtccacgtacggctggaacatcgtcaagctcatgagcgggaaggacgtgttctacctgcccccggagaagtgcgacaccctgctgtgcgacatcggcgagtccagcccctcccccaccgtggaggagagccgcaccatccgggtcctcaagatggtggagccctggctgaagaacaaccagttctgcatcaaggtgctgaacccgtacatgcccacggtcatcgagcacctcgagcgcctgcagcggaagcacggcgggatgctggtgcgcaaccccctctcccggaacagcacccacgagatgtactggatctccaacggcaccgggaacatcgtggccagcgtcaacatggtgtcccgcctgctgctcaaccggttcaccatgacgcaccgccggcccaccatcgagaaggacgtggacctgggcgccggcacccgccacgtcaacgccgagccggagacccccaacatggacgtgatcggggagcggatcaagcgcatcaaggaggagcacaacagcacgtggcactacgacgacgagaacccctacaagacctgggcgtaccacggctcctacgaggtgaaggccaccgggagcgcctccagcatgatcaacggcgtcgtgaagctgctcaccaagccgtgggacgtcgtgcccatggtgacgcagatggccatgaccgacaccacccccttcgggcagcagcgggtcttcaaggagaaggtggacacgcgcacgccccggagcatgccgggcacccgccgggtgatgggcatcaccgcggagtggctgtggcgcaccctggggcggaacaagaagccccgcctctgcacccgcgaggagttcaccaagaaggtccggaccaacgccgccatgggcgccgtgttcacggaggagaaccagtgggactccgccaaggcggccgtggaggacgaggacttctggaagctggtcgaccgcgagcgggagctgcacaagctcgggaagtgcggcagctgcgtgtacaacatgatggggaagcgcgagaagaagctgggcgagttcggcaaggccaaggggtcccgggccatctggtacatgtggctgggcgcccgctacctcgagttcgaggcgctggggttcctgaacgaggaccactggttcagccgggagaactcctacagcggcgtggagggggagggcctccacaagctgggctacatcctgcgcgacatctccaagatccccgggggcgccatgtacgccgacgacaccgccgggtgggacacccggatcaccgaggacgacctccacaacgaggagaagatcacgcagcagatggaccccgagcaccgccagctggccaacgcgatcttcaagctgacctaccagaacaaggtcgtgaaggtgcagcggccgacccccaccggcaccgtcatggacatcatcagccgcaaggaccagcggggctccggccaggtgggcacgtacgggctcaacaccttcaccaacatggaggcccagctgatccgccagatggagggcgagggggtgctgagcaaggccgacctcgagaacccccacctccccgagaagaagatcgcccagtggctggagaccaagggcgtcgagcggctcaagcgcatggccatctccggcgacgactgcgtggtgaagccgatcgacgaccggttcgcgaacgccctgctggccctcaacgacatggggaaggtccgcaaggacatcccccagtggcagcccagcaagggctggcacgactggcagcaggtccccttctgctcccaccacttccacgagctgatcatgaaggacgggcggaagctggtggtcccgtgccgcccccaggacgagctcatcggccgggcccgcatcagccaggggtccggctggagcctgcgcgagacggcgtgcctgggcaaggcctacgcccagatgtggtccctcatgtacttccaccggcgcgacctgcggctggccagcaacgccatctgctccgcggtgcccgtgcactgggtccccaccagccgcaccacctggagcatccacgcccaccaccagtggatgacgaccgaggacatgctcgccgtgtggaaccgggtgtggatcgaggacaacccgtggatggaggacaagacccccgtcaccacgtgggagaacgtgccctacctggggaagcgcgaggaccagtggtgcggctccctgatcgggctcaccagccgggccacctgggcccagaacatccccaccgcgatccagcaggtccgctccctgatcggcaacgaggagttcctggactacatgccgagcatgaagcggttccgcaaggaggaggagtccgagggggccatctggtga

SEQ ID NO: 9884 - RNA, 9873 nt, synthetic construct
  misc_feature 1..9873: note = derived and/or modified CDS sequence (opt1) from DENV-3__GU131849__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccatcgaggcgatcctgcccgagtacggcaccctggggctcgagtgctccccgcggaccggcctggacttcaacgagatgatcctgctcaccatgaagaacaaggcctggatggtgcaccgccagtggttcttcgacctgcccctgccctggacgagcggcgccaccaccgagacccccacgtggaaccggaaggagctcctggtcaccttcaagaacgcccacgccaagaagcaggaggtggtggtcctggggtcccaggagggcgcgatgcacaccgccctcaccggggccacggagatccagaacagcggcgggacctccatcttcgccggccacctgaagtgccgcctgaagatggacaagctcgagctgaagggcatgagctacgccatgtgcaccaacaccttcgtgctgaagaaggaggtgtccgagacgcagcacgggaccatcctcatcaaggtcgagtaccggggcgaggacgcgccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcgggatcctcctgacgtggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacgtggaccgagcagtacaagttccaggccgactcccccaagcggctcgccaccgccatcgccggcgcgtgggagaacggggtctgcggcatccgcagcaccacgcggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacgtgggggaaggccaagatcgtgaccgccgagacccagaacagctccttcatcatcgacggccccaacacccccgagtgccccagcgcgtcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcacgttcgtgctgctcctgtccggccagatcacctggcgcgacatgacccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggccaccatgctgcagctgcccgaggacatcgagcagatggccaacgggatcgcgctcggcctgatggccctgaagctcatcacgcagttcgagacctaccagctgtggaccgccctgatcagcctgacctgctccaacacgatgttcaccctgaccgtggcctggcgcaccgccacgctgatcctcgcgggggtcagcctgctgccggtgtgccagtccagctccatgcgcaagaccgactggctccccatggccgtcgccgccatgggcgtgccgcccctcccgctgttcatcttcagcctcaaggacaccctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacgtccgccgacctgaccgtggagaaggcggccgacatcacctgggaggaggaggccgagcagaccggcgtcagccacaacctgatgatcacggtggacgacgacgggaccatgcgcatcaaggacgacgagaccgagaacatcctcaccgtgctgctgaagaccgccctcctgatcgtctccggcgtgttcccgtacagcatccccgccacgctgctcgtgtggcacacctggcagaagcagacccagcggtccggcgtcctgtgggacgtgcccagcccgcccgagacccagaaggcggagctggaggagggggtgtaccgcatcaagcagcagggcatcttcgggaagacgcaggtcggcgtgggggtgcagaaggagggcgtcttccacaccatgtggcacgtgacccggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagacgacccccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcatccgggaggccatcaagcgccggctccgcacgctgatcctggcccccacccgggtcgtggccgccgagatggaggaggcgctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgcggcccgcgggtacatcagcacccgcgtgggcatgggcgaggccgccgcgatcttcatgaccgccacgccgcccgggacggccgacgccttcccgcagtccaacgcccccatccaggacgaggagcgggacatccccgagcgcagctggaactccggcaacgagtggatcaccgacttcgcggggaagaccgtctggttcgtgcccagcatcaaggccggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccgctggctggacgcccggacctactccgacccgctggccctcaaggagttcaaggacttcgcggccggccgcaagagcatcgccctggacctggtcacggagatcgggcgggtgccctcccacctcgcccaccgcacccggaacgccctggacaacctggtgatgctccacaccagcgagcacggcgggcgcgcgtaccggcacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcacgctggccgccatcatcgcggccaacgagatgggcctgctcgagaccaccaagcgggacctgggcatgtccaaggagccgggggtcgtgagccccacctcctacctggacgtggacctccaccccgccagcgcctggacgctgtacgcggtcgccaccaccgtgatcacccccatgctgcgccacacgatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgcgatcatcggccccggcctccaggccaaggccacccgggaggcccagaagcgcaccgccgcggggatcatgaagaacccgaccgtggacggcatcatgacgatcgacctggaccccgtcatctacgactccaagttcgagaagcagctgggccaggtgatgctcctggtgctgtgcgccgtccagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagatcacgcaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggcgagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatggagatcaccgccgagtggctctggcggaccctgggccgcaacaagaagccccgcctgtgcacgcgggaggagttcaccaagaaggtgcgcaccaacgccgcgatgggggccgtcttcaccgaggagaaccagtgggactccgccaaggccgccgtggaggacgaggacttctggaagctcgtggaccgggagcgcgagctgcacaagctgggcaagtgcgggagctgcgtctacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgcggacgacacggccggctgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccgggaccgtgatggacatcatcagccggaaggaccagcgcggctccggccaggtcgggacctacggcctgaacacgttcaccaacatggaggcccagctcatccggcagatggagggggagggcgtgctgagcaaggcggacctggagaactcccacctccccgagaagaagatcacccagtggctggagaccaagggggtggagcgcctgaagcggatggccatcagcggcgacgactgcgtcgtgaagccgatcgacgaccgcttcgccaacgccctcctggccctgaacgacatgggcaaggtgcggaaggacatcccccagtggcagccctccaaggggtggcacgactggcagcaggtccccttctgcagccaccacttccacgagctcatcatgaaggacggccgcaagctggtggtgccgtgccggccccaggacgagctgatcgggcgcgcgcgcatctcccagggcgccgggtggagcctccgggagacggcctgcctgggcaaggcctacgcgcagatgtggtccctgatgtacttccaccgccgggacctccgcctggccagcaacgccatctgctccgccgtccccgtgcactgggtgcccaccagccggaccacctggagcatccacgcccaccaccagtggatgacgaccgaggacatgctgaccgtctggaaccgcgtgtggatcgaggacaacccgtggatggaggacaagacccccgtgacgacctgggagaacgtcccctacctcggcaagcgggaggaccagtggtgcgggtccctgatcggcctgaccagccgcgcgacctgggcccagaacatccccacggccatccagcaggtccggtccctcatcgggaacgaggagttcctggactacatgccgagcatgaagcgcttccggaaggaggaggagtccgagggcgccatctggtga

SEQ ID NO: 9885 - RNA, 9873 nt, synthetic construct
  misc_feature 1..9873: note = derived and/or modified CDS sequence (opt1) from DENV-3__GQ868546__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcatccgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgacggccacgccgcccgggaccgccgacgccttcccgcagtccaacgcccccatccaggacgaggagcgggacatccccgagcgcagctggaactccggcaacgagtggatcaccgacttcgcggggaagacggtctggttcgtgcccagcatcaaggccggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccgctggctggacgcccggacctactccgacccgctggccctcaaggagttcaaggacttcgcggccggccgcaagagcatcgccctggacctggtcaccgagatcgggcgggtgccctcccacctcgcccaccgcacccggaacgccctggacaacctggtgatgctccacacgagcgagcacggcgggcgcgcgtaccggcacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccctggccgccatcatcgcggccaacgagatgggcctgctcgagaccacgaagcgggacctgggcatgtccaaggagccgggggtcgtgagccccacctcctacctggacgtggacctccaccccgccagcgcctggaccctgtacgcggtcgccaccacggtgatcacccccatgctgcgccacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgggaggcccagaagcgcacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcggaccagctgggccctctgcgaggccctgacgctggcgaccggccccatcaccaccctctgggagggctcccccgggaagttctggaacacgaccatcgccgtgagcatggccaacatcttccgcggctcctacctggccggggccggcctggcgttcagcatcatgaagtccgtggggaccggcaagcggggcaccgggagccagggcgagaccctcggggagaagtggaagaagaagctgaaccagctgagccgcaaggagttcgacctctacaagaagtccggcatcacggaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcacgatgacccaccggcgcccgaccatcgagaaggacgtggacctcggcgccggcacccggcacgtgaacgccgagcccgagacgcccaacatggacgtcatcggggagcgcatcaagcggatcaaggaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgcgtgttcaaggagaaggtcgacacccggaccccgcgcagcatgcccggcacccggcgcgtgatggagatcacggccgagtggctctggcggaccctgggccgcaacaagaagccccgcctgtgcacccgggaggagttcaccaagaaggtgcgcacgaacgccgcgatgggggccgtcttcaccgaggagaaccagtgggactccgccaaggccgccgtggaggacgaggacttctggaagctcgtggaccgggagcgcgagctgcacaagctgggcaagtgcgggagctgcgtctacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgcggacgacaccgccggctgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccgggacggtgatggacatcatcagccggaaggaccagcgcggctccggccaggtcgggacctacggcctgaacaccttcaccaacatggaggcccagctcatccggcagatggagggggagggcgtgctgagcaaggcggacctggagaacccccacctcccggagaagaagatcacgcagtggctggagaccaagggggtggagcgcctgaagcggatggccatctccggcgacgactgcgtcgtgaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtggtgccctgccggccccaggacgagctgatcgggcgcgcgcgcatcagccagggcgccgggtggtccctccgggagaccgcctgcctgggcaaggcctacgcgcagatgtggagcctgatgtacttccaccgccgggacctccgcctggcctccaacgccatctgcagcgccgtccccgtgcactgggtgccgacctcccggacgacctggagcatccacgcccaccaccagtggatgaccaccgaggacatgctgacggtctggaaccgcgtgtggatcgaggacaacccctggatggaggacaagacccccgtgaccacctgggagaacgtcccctacctcggcaagcgggaggaccagtggtgcgggagcctgatcggcctgacgtcccgcgcgacctgggcccagaacatcccgaccgccatccagcaggtccggagcctcatcgggaacgaggagttcctggactacatgccctccatgaagcgcttccggaaggaggaggagagcgagggcgccatctggtga

SEQ ID NO: 9886 - RNA, 9873 nt, synthetic construct
  misc_feature 1..9873: note = derived and/or modified CDS sequence (opt1) from DENV-3__GU131850__SS-prME
  source 1..9873: mol_type = other RNA
accagcctgtgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgatcaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcgggatcctcctgacgtggatcggcctgaacagcaagaacacctccatgagcttctcctgcatcgccatcgggatcatcaccctctacctgggcgccgtggtgcaggcggacatcgggtgcgtcatcaactggaagggcaaggagctgaagtgcggcagcgggatcttcgtgaccaacgaggtgcacacgtggaccgagcagtacaagttccaggccgactcccccaagcggctcgccaccgccatcgccggcgcgtgggagaacggggtctgcggcatccgcagcaccacgcggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacgtgggggaaggccaagatcgtgaccgccgagacccagaacagctccttcatcatcgacggccccaacacccccgagtgccccagcgcgtcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcacgttcgtgctgctcctgtccggccagatcacctggcgcgacatgacccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatgttcaccctgaccgtggcctggcgcacggccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacaccctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcacggggacctccgccgacctgaccgtggagaaggcggccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcgtgttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcatccgggaggccatcaagcgccggctccgcacgctgatcctggcccccacccgggtcgtggccgccgagatggaggaggcgctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgcggcccgcgggtacatcagcacccgcgtgggcatgggcgaggccgccgcgatcttcatgaccgccacgccgcccgggacggccgacgccttcccgcagtccaacgcccccatccaggacgaggagcgggacatccccgagcgcagctggaactccggcaacgagtggatcaccgacttcgtcgggaagaccgtgtggttcgtgcccagcatcaaggcgggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccgctggctggacgcccggacctactccgacccgctggccctcaaggagttcaaggacttcgccgcgggccgcaagagcatcgccctggacctggtgacggagatcgggcgggtgccctcccacctcgcccaccgcacccggaacgccctggacaacctggtcatgctccacaccagcgagcacggcgggcgcgcctaccggcacgcggtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcacgctggccgccatcatcgccgcgaacgagatgggcctgctcgagaccaccaagcgggacctgggcatgtccaaggagccgggggtggtgagccccaactcctacctggacgtcgacctccaccccgccagcgcctggaccctgtacgccgtggcgacgaccgtgatcacccccatgctgcgccacaccatcgagaactccacggccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgaccgccgccgtgctcctgctgatcacccactacgccatcatcggccccggcctccaggcgaaggccacgcgggaggcccagaagcgcaccgccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcggacgagctgggccctctgcgaggccctgaccctggccaccggccccatcaccacgctctgggagggctcccccgggaagttctggaacaccaccatcgcggtgagcatggccaacatcttccgcggctcctacctggccggggccggcctggccttcagcatcatgaagtccgtcgggaccggcaagcggggcacggggagccagggcgagaccctcggggagaagtggaagaagaagctgaaccagctgagccgcaaggagttcgacctctacaagaagtccggcatcaccgaggtggaccggaccgaggcgaaggaggggctgaagaagggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcacggaggtgcgcggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcacggggaacatcgtggccagcgtcaacatggtgtcccgcctcctgctgaaccggttcaccatgacccaccgccggccgaccatcgagaaggacgtggacctcggcgcgggcacgcgccacgtcaacgccgagcccgagacccccaacatggacgtgatcggggagcggatcaagcgcatcaaggaggagcacaacagcacctggcactacgacgacgagaacccgtacaagacctgggcctaccacggctcctacgaggtgaaggccacggggagcgcctccagcatgatcaacggcgtcgtgaagctgctgaccaagccctgggacgtcgtgcccatggtgacccagatggcgatgaccgacacgacccccttcgggcagcagcgggtcttcaaggagaaggtggacacccgcaccccgcggagcatgcccggcacgcgccgggtgatgggcatcaccgccgagtggctctggcgcaccctggggcggaacaagaagccccgcctgtgcacccgcgaggagttcacgaagaaggtccggaccaacgccgccatgggcgcggtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtcgtgaaggtgcagcggcccacgcccaccggcaccgtcatggacatcatcagccgcaaggaccagcggggctccggccaggtgggcacctacgggctgaacaccttcacgaacatggaggcccagctcatccgccagatggagggcgagggggtgctgagcaaggccgacctggagaacccccacctcccggagaagaagatcacccagtggctggagaccaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccctccgcgagaccgcctgcctgggcaaggcctacgcccagatgtggagcctgatgtacttccaccggcgcgacctccggctggcgtccaacgccatctgcagcgccgtgcccgtgcactgggtcccgacgtcccgcaccacctggagcatccacgcccaccaccagtggatgaccacggaggacatgctgaccgtgtggaaccgggtgtggatcgaggacaacccctggatggaggacaagacccccgtcaccacgtgggagaacgtgccctacctcgggaagcgcgaggaccagtggtgcggcagcctgatcgggctgacctcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 9887 - RNA, 9873 nt, synthetic construct
  misc_feature 1..9873: note = derived and/or modified CDS sequence (opt1) from DENV-3__GU131851__SS-prME
  source 1..9873: mol_type = other RNA
accagcctgtgcctcgtgatgatcctgcccgccgccctggcgttccacctcaccagccgggacggggagccgcacatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcgccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggctgttcgacctgcccctcccctggaccagcggcgccaccaccgagacgcccacctggaaccgcaaggagctgctggtcaccttcaagaacgcccacgccaagaagcaggaggtggtggtcctcgggtcccaggagggcgcgatgcacaccgccctgacgggggccaccgagatccagaacagcggcgggacctccatcttcgccggccacctgaagtgccggctcaagatggacaagctggagctgaagggcatgagctacgccatgtgcaccaacacgttcgtgctcaagaaggaggtgtccgagacccagcacgggaccatcctgatcaaggtcgagtaccgcggcgaggacgcgccgtgcaagatccccttcagcaccgaggacgggcagggcaaggcccacaacggccggctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccgcggcgcccggcgcatggccatcctcggcgacaccgcgtgggacttcgggtccgtgggcggggtcctgaacagcctgggcaagatggtgcaccagatcttcgggtccgcctacacggccctcttcagcggcgtgtcctgggtcatgaagatcggcatcgggatcctgctgacctggatcggcctcaacagcaagaacacctccatgagcttctcctgcatcgccatcgggatcatcaccctgtacctgggcgccgtggtgcaggcggacatggggtgcgtcatcaactggaagggcaaggagctcaagtgcggcagcgggatcttcgtgacgaacgaggtgcacacctggaccgagcagtacaagttccaggccgactcccccaagcgcctggccaccgccatcgccggcgcgtgggagaacggggtctgcggcatccggagcacgacccgcatggagaacctgctctggaagcagatcgccaacgagctgaactacatcctgtgggagaacaacatcaagctcaccgtggtggtcggggacatcatcggcgtgctggagcagggcaagcggaccctgacgccccagccgatggagctcaagtactcctggaagacctgggggaaggccaagatcgtgaccgccgagacccagaacagctccttcatcatcgacggccccaacacgcccgagtgccccagcgcgtcccgcgcctggaacgtctgggaggtggaggactacgggttcggcgtgttcaccaccaacatctggctgaagctgcgggaggtctacacccagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacctgcacgtggccgaagtcccacaccctgtggagcaacggcgtgctggagtccgacatgatcatccccaagagcctcgccgggcccatctcccagcacaaccaccgcccgggctaccacacccagaccgccgggccctggcacctgggcaagctggagctcgacttcaactactgcgagggcacgaccgtggtcatcaccgagaactgcgggacccggggccccagcctgcgcacgaccaccgtgtccgggaagctgatccacgagtggtgctgccggagctgcaccctgccgcccctgcgctacatgggcgaggacgggtgctggtacggcatggagatccggcccatctccgagaaggaggagaacatggtcaagagcctggtctccgccggcagcgggaaggtggacaacttcacgatgggcgtgctctgcctggcgatcctgttcgaggaggtcatgcgcgggaagttcggcaagaagcacatgatcgccggggtgttcttcaccttcgtgctcctgctgtccggccagatcacctggcgggacatgacccacacgctcatcatgatcggcagcaacgcctccgaccgcatggggatgggcgtcacctacctggccctgatcgccaccttcaagatccagcccttcctcgcgctggggttcttcctgcggaagctcaccagccgcgagaacctgctgctcggcgtgggcctggccatggccacgaccctgcagctccccgaggacatcgagcagatggccaacgggatcgcgctgggcctgatggccctcaagctgatcacccagttcgagacctaccagctgtggacggccctcatcagcctgacctgctccaacaccatgttcaccctgacggtggcctggcggaccgccaccctcatcctggcgggggtcagcctgctccccgtgtgccagtccagctccatgcgcaagaccgactggctgcccatggccgtcgccgccatgggcgtgccgcccctccccctgttcatcttcagcctgaaggacacgctgaagcgccggtcctggcccctcaacgagggggtgatggccgtcggcctggtgagcatcctggcgtccagcctcctgcgcaacgacgtgcccatggccggccccctggtcgccgggggcctcctgatcgcctgctacgtgatcaccgggacctccgccgacctgaccgtggagaaggcggccgacatcacgtgggaggaggaggccgagcagaccggcgtcagccacaacctcatgatcaccgtggacgacgacgggaccatgcggatcaaggacgacgagaccgagaacatcctgacggtgctgctcaagaccgccctgctgatcgtctccggcgtgttcccgtacagcatccccgccaccctcctggtgtggcacacctggcagaagcagacgcagcgctccggcgtcctgtgggacgtgccctccccgcccgagacccagaaggcggagctcgaggagggggtgtaccggatcaagcagcagggcatcttcgggaagacccaggtcggcgtgggggtgcagaaggagggcgtcttccacaccatgtggcacgtgacgcgcggcgccgtgctgacctacaacgggaagcggctggagcccaactgggcctccgtcaagaaggacctcatcagctacggcgggggctggcgcctgtccgcccagtggcagaagggggaggaggtccaggtgatcgcggtcgagcccggcaagaaccccaagaacttccagaccaccccgggcacgttccagaccaccaccggggagatcggcgccatcgccctggacttcaagcccgggacgagcggcagccccatcatcaaccgggagggcaaggtggtggggctgtacggcaacggggtcgtgaccaagaacggcgggtacgtgtccggcatcgcccagaccaacgccgagccggacggccccacccccgagctcgaggaggagatgttcaagaagcgcaacctgacgatcatggacctgcaccccgggagcggcaagacccggaagtacctcccggcgatcatccgcgaggccatcaagcggcgcctgcggaccctgatcctcgcccccacccgcgtcgtggccgccgagatggaggaggcgctgaaggggctgcccatccggtaccagacgaccgccaccaagtccgagcacaccggccgcgagatcgtggacctcatgtgccacgccacgttcaccatgcggctgctgagccccgtccgcgtgccgaactacaacctcatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctgcgcaagaacgggaagaaggtgatccagctgtcccggaagaccttcgacaccgagtaccagaagaccaagctcaacgactgggacttcgtcgtgacgaccgacatcagcgagatgggcgccaacttcaaggccgaccgcgtgatcgacccgcggcgctgcctgaagcccgtcatcctgaccgacggccccgagcgggtgatcctcgcggggcccatgccggtgaccgccgcctccgccgcccagcgccggggccgcgtcgggcggaacccccagaaggagaacgaccagtacatcttcaccggccagcccctgaacaacgacgaggaccacgcgcactggacggaggccaagatgctgctcgacaacatcaacacccccgaggggatcatcccggccctgttcgagcccgagcgcgagaagtccgccgcgatcgacggcgagtaccggctgaagggcgagtcccgcaagaccttcgtggagctcatgcggcgcggggacctgcccgtgtggctggcccacaaggtcgccagcgagggcatcaagtacaccgaccggaagtggtgcttcgacgggcagcgcaacaaccagatcctcgaggagaacatggacgtggagatctggacgaaggagggcgagaagaagaagctgcggccccgctggctggacgcccgcacctactccgacccgctcgccctgaaggagttcaaggacttcgcggccggccgcaagagcatcgccctggacctcgtcaccgagatcgggcgcgtgccctcccacctggcccaccggacccgcaacgccctggacaacctcgtgatgctgcacacgagcgagcacggcgggcgggcgtaccgccacgccgtcgaggagctgcccgagaccatggagaccctcctgctgctcggcctgatgatcctgctcaccgggggcgccatgctgttcctgatcagcggcaaggggatcggcaagacgtccatcgggctcatctgcgtgatcgccagctccggcatgctgtggatggccgagatcccgctgcagtggatcgcgagcgccatcgtgctcgagttcttcatgatggtcctgctgatccccgagcccgagaagcagcggacgccccaggacaaccagctcgcctacgtggtgatcgggatcctgaccctggccgccatcatcgcggccaacgagatgggcctcctggagaccacgaagcgcgacctgggcatgtccaaggagccgggggtcgtgagccccacctcctacctcgacgtggacctgcaccccgccagcgcctggaccctgtacgcggtcgccaccacggtgatcacccccatgctccggcacaccatcgagaactccaccgccaacgtgagcctggccgccatcgcgaaccaggccgtcgtgctgatgggcctcgacaaggggtggccgatctccaagatggacctgggcgtgcccctgctcgccctggggtgctacagccaggtcaaccccctgacgctcaccgccgccgtgctgctgctcatcacccactacgcgatcatcggccccggcctgcaggccaaggccacccgcgaggcccagaagcggacggccgcggggatcatgaagaacccgaccgtggacggcatcatgaccatcgacctggaccccgtcatctacgactccaagttcgagaagcagctcggccaggtgatgctgctggtgctctgcgccgtccagctgctgctcatgcgcaccagctgggccctgtgcgaggccctgacgctcgcgaccggccccatcaccaccctgtgggagggctcccccgggaagttctggaacacgaccatcgccgtgagcatggccaacatcttccggggctcctacctggccggggccggcctcgcgttcagcatcatgaagtccgtggggaccggcaagcgcggcaccgggagccagggcgagaccctgggggagaagtggaagaagaagctgaaccagctcagccggaaggagttcgacctgtacaagaagtccggcatcacggaggtcgaccgcaccgaggccaaggaggggctgaagcggggcgagatcacccaccacgccgtgagccgcggctccgccaagctccagtggttcgtggagcggaacatggtcatcccggaggggcgcgtgatcgacctgggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctcatgagcgggaaggacgtcttctacctgccgcccgagaagtgcgacaccctgctgtgcgacatcggcgagtccagcccctcccccaccgtggaggagagccgcacgatccgggtgctcaagatggtcgagccgtggctgaagaacaaccagttctgcatcaaggtgctgaacccctacatgcccaccgtgatcgagcacctcgagcgcctgcagcggaagcacggcgggatgctggtccgcaaccccctctcccggaacagcacccacgagatgtactggatctccaacggcaccgggaacatcgtggcgagcgtgaacatggtctcccgcctgctgctcaaccggttcacgatgacccaccgccggccgaccatcgagaaggacgtggacctgggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtggtcaagctgctcacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatggagatcacggccgagtggctgtggcgcaccctgggccggaacaagaagccccgcctctgcacccgcgaggagttcaccaagaaggtgcggacgaacgccgcgatgggggccgtcttcaccgaggagaaccagtgggactccgccaaggccgccgtggaggacgaggacttctggaagctggtggaccgcgagcgggagctgcacaagctcggcaagtgcgggagctgcgtctacaacatgatgggcaagcgcgagaagaagctgggggagttcggcaaggcgaagggctcccgggccatctggtacatgtggctgggggcccgctacctcgagttcgaggccctgggcttcctgaacgaggaccactggttcagccgggagaactcctacagcggggtggagggcgaggggctccacaagctgggctacatcctgcgcgacatctccaagatccccggcggggccatgtacgcggacgacaccgccggctgggacacccggatcacggaggacgacctccacaacgaggagaagatcacccagcagatggacccggagcaccgccagctggccaacgccatcttcaagctgacctaccagaacaaggtggtcaaggtgcagcggcccacccccaccgggacggtgatggacatcatcagccgcaaggaccagcggggctccggccaggtcgggacctacggcctcaacaccttcaccaacatggaggcccagctgatccgccagatggagggggagggcgtgctgagcaaggcggacctcgagaacccccacctcccggagaagaagatcacgcagtggctggagaccaagggggtggagcggctcaagcgcatggccatctccggcgacgactgcgtcgtgaagcccatcgacgaccggttcgccaacgccctgctggccctcaacgacatgggcaaggtgcgcaaggacatcccccagtggcagcccagcaaggggtggcacgactggcagcaggtcccgttctgctcccaccacttccacgagctgatcatgaaggacggccggaagctggtggtgccctgccgcccccaggacgagctcatcgggcgggcgcgcatcagccagggcgccgggtggtccctgcgcgagaccgcctgcctgggcaaggcctacgcgcagatgtggagcctcatgtacttccaccggcgcgacctgcggctggcctccaacgccatctgcagcgccgtccccgtgcactgggtgccgacctcccgcacgacctggagcatccacgcccaccaccagtggatgaccaccgaggacatgctcacggtctggaaccgggtgtggatcgaggacaacccctggatggaggacaagacccccgtgaccacctgggagaacgtcccctacctgggcaagcgcgaggaccagtggtgcgggagcctgatcggcctcacgtcccgggcgacctgggcccagaacatcccgaccgccatccagcaggtccgcagcctgatcgggaacgaggagttcctggactacatgccctccatgaagcggttccgcaaggaggaggagagcgagggcgccatctggtga

SEQ ID NO: 9888 - RNA, 9873 nt, synthetic construct
  misc_feature 1..9873: note = derived and/or modified CDS sequence (opt1) from DENV-3__GQ868547__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatggtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtccacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcatccgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgacggccacgccgcccgggaccgccgacgccttcccgcagtccaacgcccccatccaggacgaggagcgggacatccccgagcgcagctggaactccggcaacgagtggatcaccgacttcgcggggaagacggtctggttcgtgcccagcatcaaggccggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccgctggctggacgcccggacctactccgacccgctggccctcaaggagttcaaggacttcgcggccggccgcaagagcatcgccctggacctggtcaccgagatcgggcgggtgccctcccacctcgcccaccgcacccggaacgccctggacaacctggtgatgctccacacgagcgagcacggcgggcgcgcgtaccggcacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccctggccgccatcatcgcggccaacgagatgggcctgctcgagaccacgaagcgggacctgggcatgtccaaggagccgggggtcgtgagccccacctcctacctggacgtggacctccaccccgccagcgcctggaccctgtacgcggtcgccaccacggtgatcacccccatgctgcgccacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgggaggcccagaagcgcacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcggaccagctgggccctctgcgaggccctgacgctggcgaccggccccatcaccaccctctgggagggctcccccgggaagttctggaacacgaccatcgccgtgagcatggccaacatcttccgcggctcctacctggccggggccggcctggcgttcagcatcatgaagtccgtggggaccggcaagcggggcaccgggagccagggcgagaccctcggggagaagtggaagaagaagctgaaccagctgagccgcaaggagttcgacctctacaagaagtccggcatcacggaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcacgatgacccaccggcgcccgaccatcgagaaggacgtggacctcggcgccggcacccggcacgtgaacgccgagcccgagacgcccaacatggacgtcatcggggagcgcatcaagcggatcaaggaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgcgtgttcaaggagaaggtcgacacccggaccccgcgcagcatgcccggcacccggcgcgtgatggagatcacggccgagtggctctggcggaccctgggccgcaacaagaagccccgcctgtgcacccgggaggagttcaccaagaaggtgcgcacgaacgccgcgatgggggccgtcttcaccgaggagaaccagtgggactccgccaaggccgccgtggaggacgaggacttctggaagctcgtggaccgggagcgcgagctgcacaagctgggcaagtgcgggagctgcgtctacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgcggacgacaccgccggctgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccgggacggtgatggacatcatcagccggaaggaccagcgcggctccggccaggtcgggacctacggcctgaacaccttcaccaacatggaggcccagctcatccggcagatggagggggagggcgtgctgagcaaggcggacctggagaacccccacctcccggagaagaagatcacgcagtggctggagaccaagggggtggagcgcctgaagcggatggccatctccggcgacgactgcgtcgtgaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtggtgccctgccggccccaggacgagctgatcgggcgcgcgcgcatcagccagggcgccgggtggtccctccgggagaccgcctgcctgggcaaggcctacgcgcagatgtggagcctgatgtacttccaccgccgggacctccgcctggcctccaacgccatctgcagcgccgtccccgtgcactgggtgccgacctcccggacgacctggagcatccacgcccaccaccagtggatgaccaccgaggacatgctgacggtctggaaccgcgtgtggatcgaggacaacccctggatggaggacaagacccccgtgaccacctgggagaacgtcccctacctcggcaagcgggaggaccagtggtgcgggagcctgatcggcctgacgtcccgcgcgacctgggcccagaacatcccgaccgccatccagcaggtccggagcctcatcgggaacgaggagttcctggactacatgccctccatgaagcgcttccggaaggaggaggagagcgagggcgccatctggtga

SEQ ID NO: 9889 - RNA, 9873 nt, synthetic construct
  misc_feature 1..9873: note = derived and/or modified CDS sequence (opt1) from DENV-3__GU131857__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcatccgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgacggccacgccgcccgggaccgccgacgccttcccgcagtccaacgcccccatccaggacgaggagcgggacatccccgagcgcagctggaactccggcaacgagtggatcaccgacttcgtcgggaagacggtgtggttcgtgcccagcatcaaggcgggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccgctggctggacgcccggacctactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccacgaagcgggacctgggcatgtccaaggagccgggggtggtgagccccacctcctacctggacgtcgacctccaccccgccagcgcctggaccctgtacgccgtggcgaccacggtgatcacccccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgacgctgaccgccgccgtgctcctgctgatcacccactacgccatcatcggccccggcctccaggcgaaggccacccgggaggcccagaagcgcacggccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgacgctggccaccggccccatcaccaccctctgggagggctcccccgggaagttctggaacacgaccatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggagttcgacctctacaagaagtccggcatcacggaggtggaccggaccgaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccggacgatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcacgatgacccaccggcgcccgaccatcgagaaggacgtggacctcggcgcgggcacccggcacgtcaacgccgagcccgagacgcccaacatggacgtgatcggggagcgcatcaagcggatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggcgatgaccgacaccacgcccttcgggcagcagcgcgtcttcaaggagaaggtggacacccggaccccgcgcagcatgcccggcacccggcgcgtgatggagatcacggccgagtggctctggcggaccctgggccgcaacaagaagccccgcctgtgcacccgggaggagttcaccaagaaggtccgcacgaacgccgccatgggggcggtgttcaccgaggagaaccagtgggactccgccaaggccgccgtggaggacgaggacttctggaagctcgtcgaccgggagcgcgagctgcacaagctgggcaagtgcgggagctgcgtgtacaacatgatgggcaagcgggagaagaagctcggggagttcggcaaggccaagggctcccgcgcgatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtcgtgaaggtgcagcgccccacccccaccgggacggtcatggacatcatcagccggaaggaccagcgcggctccggccaggtggggacctacggcctgaacaccttcaccaacatggaggcccagctcatccggcagatggagggggagggcgtgctgagcaaggccgacctggagaacccccacctcccggagaagaagatcacgcagtggctggagaccaagggggtcgagcgcctgaagcggatggcgatctccggcgacgactgcgtggtgaagcccatcgacgaccgcttcgccaacgccctcctggccctgaacgacatgggcaaggtccggaaggacatcccccagtggcagcccagcaaggggtggcacgactggcagcaggtcccgttctgctcccaccacttccacgagctcatcatgaaggacggccgcaagctggtggtcccctgccggccccaggacgagctgatcgggcgcgcccgcatcagccagggcgcggggtggtccctccgggagaccgcctgcctgggcaaggcctacgcccagatgtggagcctgatgtacttccaccgccgggacctccgcctggcgtccaacgccatctgcagcgccgtgcccgtgcactgggtcccgacctcccggacgacctggagcatccacgcccaccaccagtggatgaccaccgaggacatgctgacggtgtggaaccgcgtgtggatcgaggacaacccctggatggaggacaagacccccgtcaccacctgggagaacgtgccctacctcggcaagcgggaggaccagtggtgcgggagcctgatcggcctgacgtcccgcgccacctgggcgcagaacatcccgaccgccatccagcaggtccggagcctcatcgggaacgaggagttcctggactacatgccctccatgaagcgcttccggaaggaggaggagagcgagggcgccatctggtga

SEQ ID NO: 9890 - RNA, 9873 nt, synthetic construct
  misc_feature 1..9873: note = derived and/or modified CDS sequence (opt1) from DENV-3__GU131858__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgatcaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcgggatcctcctgacgtggatcggcctgaacagcaagaacacctccatgagcttctcctgcatcgccatcgggatcatcaccctctacctgggcgccgtggtgcaggcggacatcgggtgcgtcatcaactggaagggcaaggagctgaagtgcggcagcgggatcttcgtgaccaacgaggtgcacacgtggaccgagcagtacaagttccaggccgactcccccaagcggctcgccaccgccatcgccggcgcgtgggagaacggggtctgcggcatccgcagcaccacgcggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacgtgggggaaggccaagatcgtgaccgccgagacccagaacagctccttcatcatcgacggccccaacacccccgagtgccccagcgcgtcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggaccagcggcccctccctcaccacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtcagcgccggctccgggaaggtggacaacttcacgatgggcgtgctgtgcctcgcgatcctgttcgaggaggtcatgcgggggaagttcggcaagaagcacatgatcgccggggtgttcttcaccttcgtgctgctcctgagcggccagatcacctggcgcgacatgacccacacgctgatcatgatcggctccaacgccagcgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatctccctgacctgcagcaacaccatgttcaccctgacggtggcctggcgcaccgccaccctgatcctcgcgggggtctccctgctgccggtgtgccagagctccagcatgcggaagaccgactggctccccatggccgtcgccgccatgggcgtgccgcccctcccgctgttcatcttctccctcaaggacacgctgaagcgccgcagctggcccctgaacgagggggtgatggccgtcggcctcgtgtccatcctggcgagctccctgctccggaacgacgtgcccatggccggccccctggtcgccgggggcctgctcatcgcctgctacgtgatcaccgggaccagcgccgacctgaccgtggagaaggcggccgacatcacgtgggaggaggaggccgagcagaccggcgtctcccacaacctgatgatcaccgtggacgacgacgggaccatgcgcatcaaggacgacgagaccgagaacatcctcacggtgctgctgaagaccgccctcctgatcgtcagcggcgtgttcccgtactccatccccgccaccctgctcgtgtggcacacctggcagaagcagacgcagcggagcggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggccagcgtcaagaaggacctgatctcctacggcgggggctggcggctcagcgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggctcccccatcatcaaccgcgagggcaaggtggtggggctgtacggcaacggggtcgtgacgaagaacggcgggtacgtgagcggcatcgcccagaccaacgccgagccggacggccccacccccgagctggaggaggagatgttcaagaagcggaacctcaccatcatggacctgcaccccgggtccggcaagacgcgcaagtacctgccggcgatcatccgggaggccatcaagcgccggctccgcaccctgatcctggcccccacccgggtcgtggccgccgagatggaggaggcgctcaaggggctgcccatccgctaccagaccacggccaccaagagcgagcacaccggccgggagatcgtggacctgatgtgccacgccaccttcacgatgcgcctcctgtcccccgtccgggtgccgaactacaacctgatcatcatggacgaggcccacttcaccgaccccgccagcatcgcggcccgcgggtacatctccacccgggtgggcatgggcgaggccgccgcgatcttcatgaccgccacgccgcccgggaccgccgacgccttcccgcagagcaacgcccccatccaggacgaggagcgcgacatccccgagcgctcctggaacagcggcaacgagtggatcaccgacttcgtcgggaagaccgtgtggttcgtgccctccatcaaggcgggcaacgacatcgccaactgcctccggaagaacgggaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacggccccgagcgcgtgatcctggccgggcccatgccggtcaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtggagctgatgcgccgcggggacctccccgtctggctggcgcacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtacagcgacccgctggccctcaaggagttcaaggacttcgccgcgggccgcaagtccatcgccctggacctggtgaccgagatcgggcgggtgcccagccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgagcaaggagccgggggtggtgtcccccaacagctacctggacgtcgacctccaccccgcctccgcctggacgctgtacgccgtggcgaccaccgtgatcacccccatgctgcgccacacgatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgaccctgaccgccgccgtgctcctgctgatcacgcactacgccatcatcggccccggcctccaggcgaaggccacccgggaggcccagaagcgcaccgccgccgggatcatgaagaacccgaccgtcgacggcatcatgacgatcgacctggaccccgtgatctacgacagcaagttcgagaagcagctgggccaggtgatgctcctggtcctgtgcgcggtgcagctcctgctgatgcggacctcctgggccctctgcgaggccctgaccctggccaccggccccatcacgaccctctgggagggcagccccgggaagttctggaacaccaccatcgcggtgtccatggccaacatcttccgcggcagctacctggccggggccggcctggccttctccatcatgaagtccgtcgggacgggcaagcggggcaccgggagccagggcgagaccctcggggagaagtggaagaagaagctgaaccagctgtcccgcaaggagttcgacctctacaagaagtccggcatcaccgaggtggaccggaccgaggcgaaggaggggctgaagcgcggcgagatcacgcaccacgccgtgtcccggggcagcgccaagctgcagtggttcgtcgagcgcaacatggtgatcccggaggggcgggtgatcgacctcggctgcgggcgcggcgggtggtcctactactgcgccggcctgaagaaggtcaccgaggtgcggggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacgcacgagatgtactggatcagcaacggcaccgggaacatcgtggcctccgtcaacatggtgagccggctcctgctgaaccgcttcaccatgacccaccggcgcccgacgatcgagaaggacgtggacctcggcgcgggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtgaaggccaccgggtccgccagcagcatgatcaacggcgtcgtgaagctgctgaccaagccctgggacgtcgtgcccatggtgacccagatggcgatgacggacaccacccccttcgggcagcagcgcgtcttcaaggagaaggtggacacccggacgccgcgctccatgcccggcacccggcgcgtgatgggcatcaccgccgagtggctctggcggaccctggggcgcaacaagaagccccggctgtgcacgcgcgaggagttcaccaagaaggtccgcaccaacgccgccatgggcgcggtgttcaccgaggagaaccagtgggacagcgccaaggccgccgtggaggacgaggacttctggaagctcgtcgaccgggagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacacggcggggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcggcagcggccaggtgggcacctacgggctgaacacgttcaccaacatggaggcccagctcatccggcagatggagggcgagggggtgctgtccaaggccgacctggagaacccccacctcccggagaagaagatcacccagtggctggagaccaagggcgtcgagcgcctgaagcggatggcgatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcccggatctcccagggggcgggctggagcctccgcgagacggcctgcctgggcaaggcctacgcccagatgtggtccctgatgtacttccaccgccgggacctccgcctggcgagcaacgccatctgctccgccgtgcccgtgcactgggtcccgaccagccggaccacctggagcatccacgcccaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggctccctgatcgggctgaccagccgcgccacctgggcgcagaacatcccgacggccatccagcaggtccggtccctcatcggcaacgaggagttcctggactacatgcccagcatgaagcgcttccggaaggaggaggagtccgagggggccatctggtga

SEQ ID NO: 9891 - RNA, 9873 nt, synthetic construct
  misc_feature 1..9873: note = derived and/or modified CDS sequence (opt1) from DENV-3__GQ868548__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagcacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcatccgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgacggccacgccgcccgggaccgccgacgccttcccgcagtccaacgcccccatccaggacgaggagcgggacatccccgagcgcagctggaactccggcaacgagtggatcaccgacttcgtcgggaagacggtgtggttcgtgcccagcatcaaggcgggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccgctggctggacgcccggacctactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccacgaagcgggacctgggcatgtccaaggagccgggggtggtgagccccacctcctacctggacgtcgacctccaccccgccagcgcctggaccctgtacgccgtggcgaccacggtgatcacccccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgacgctgaccgccgccgtgctcctgctgatcacccactacgccatcatcggccccggcctccaggcgaaggccacccgggaggcccagaagcgcacggccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgacgctggccaccggccccatcaccaccctctgggagggctcccccgggaagttctggaacacgaccatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggagttcgacctctacaagaagtccggcatcacggaggtggaccggaccgaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccggacgatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcacgatgacccaccggcgcccgaccatcgagaaggacgtggacctcggcgcgggcacccggcacgtcaacgccgagcccgagacgcccaacatggacgtgatcggggagcgcatcaagcggatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggcgatgaccgacaccacgcccttcgggcagcagcgcgtcttcaaggagaaggtggacacccggaccccgcgcagcatgcccggcacccggcgcgtgatggagatcacggccgagtggctctggcggaccctgggccgcaacaagaagccccgcctgtgcacccgggaggagttcaccaagaaggtccgcacgaacgccgccatgggggcggtgttcaccgaggagaaccagtgggactccgccaaggccgccgtggaggacgaggacttctggaagctcgtcgaccgggagcgcgagctgcacaagctgggcaagtgcgggagctgcgtgtacaacatgatgggcaagcgggagaagaagctcggggagttcggcaaggccaagggctcccgcgcgatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtcgtgaaggtgcagcgccccacccccaccgggacggtcatggacatcatcagccggaaggaccagcgcggctccggccaggtggggacctacggcctgaacaccttcaccaacatggaggcccagctcatccggcagatggagggggagggcgtgctgagcaaggccgacctggagaacccccacctcccggagaagaagatcacgcagtggctggagaccaagggggtcgagcgcctgaagcggatggcgatctccggcgacgactgcgtggtgaagcccatcgacgaccgcttcgccaacgccctcctggccctgaacgacatgggcaaggtccggaaggacatcccccagtggcagcccagcaaggggtggcacgactggcagcaggtcccgttctgctcccaccacttccacgagctcatcatgaaggacggccgcaagctggtggtcccctgccggccccaggacgagctgatcgggcgcgcccgcatcagccagggcgcggggtggtccctccgggagaccgcctgcctgggcaaggcctacgcccagatgtggagcctgatgtacttccaccgccgggacctccgcctggcgtccaacgccatctgcagcgccgtgcccgtgcactgggtcccgacctcccggacgacctggagcatccacgcccaccaccagtggatgaccaccgaggacatgctgacggtgtggaaccgcgtgtggatcgaggacaacccctggatggaggacaagacccccgtcaccacctgggagaacgtgccctacctcggcaagcgggaggaccagtggtgcgggagcctgatcggcctgacgtcccgcgccacctgggcgcagaacatcccgaccgccatccagcaggtccggagcctcatcgggaacgaggagttcctggactacatgccctccatgaagcgcttccggaaggaggaggagagcgagggcgccatctggtga

SEQ ID NO: 9892 - RNA, 9873 nt, synthetic construct
  misc_feature 1..9873: note = derived and/or modified CDS sequence (opt1) from DENV-3__GU131861__SS-prME
  source 1..9873: mol_type = other RNA
accagcctctgcctcgtgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcatccgggaggccatcaagcgccggctccgcaccctgatcctggcccccacccgggtcgtggccgccgagatggaggaggcgctcaaggggctgcccatccgctaccagacgaccgtgaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgccgcgcgcgggtacatcagcacccgcgtcggcatgggcgaggccgccgccatcttcatgacggcgacgccgcccgggaccgccgacgccttcccgcagtccaacgcccccatccaggacgaggagcgggacatccccgagcgcagctggaactccggcaacgagtggatcaccgacttcgccgggaagacggtgtggttcgtgcccagcatcaaggcgggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccgctggctggacgcccggacctactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcggtcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccacgaagcgggacctgggcatgtccaaggagccgggggtggtcagccccacctcctacctggacgtggacctccaccccgccagcgcctggaccctgtacgccgtggcgaccacggtcatcacccccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgggaggcccagaagcgcacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgacgctggccaccggccccatcaccaccctctgggagggctcccccgggaagttctggaacacgaccatcgcggtcagcatggccaacatcttccgcggctcctacctggccggggccggcctggccttcagcatcatgaagtccgtggggaccggcaagcggggcaccgggagccagggcgagaccctcggggagaagtggaagcgcaagctgaaccagctgagccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcgcggcgggtggagctactactgcgccggcctgaagaaggtgaccgaggtgcggggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccgcacgatccgggtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagaagatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgcgtgttcaaggagaaggtggacacccggaccccgcgcagcatgcccggcacccggcgcgtcatggagatcacggccgagtggctctggcggaccctgggccgcaacaagaagccccgcctgtgcacccgggaggagttcaccaagaaggtgcgcacgaacgccgccatgggggcggtgttcaccgaggagaaccagtgggactccgccaaggccgccgtcgaggacgaggacttctggaagctcgtggaccgggagcgcgagctgcacaagctgggcaagtgcgggagctgcgtgtacaacatgatgggcaagcgggagaagaagctcggggagttcggcaaggccaagggctcccgcgcgatctggtacatgtggctgggggcccggtacctggagttcgaggccctcggcttcctgaacgaggaccactggttcagccgcgagaactcctacagcggggtcgagggcgaggggctgcacaagctcggctacatcctgcgggacatctccaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccgggacggtgatggacatcatcagccggaaggaccagcgcggctccggccaggtggggacctacggcctgaacaccttcaccaacatggaggcccagctcatccggcagatggagggggagggcgtcctgagcaaggccgacctggagaacccccacctcccggagaagaagatcacgcagtggctggagaccaagggggtggagcgcctgaagcggatggcgatctccggcgacgactgcgtggtcaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccgcatcagccagggcgcggggtggtccctccgggagaccgcctgcctgggcaaggcctacgcccagatgtggagcctgatgtacttccaccgccgggacctccgcctggcgtccaacgccatctgcagcgccgtgcccgtccactgggtgccgacctcccggacgacctggagcatccacgcccaccaccagtggatgaccaccgaggacatgctgacggtgtggaaccgcgtctggatcgaggacaacccctggatggaggacaagacccccgtgaccacctgggagaacgtgccctacctcggcaagcgggaggaccagtggtgcgggagcctgatcggcctgacgtcccgcgccacctgggcgcagaacatcccgaccgccatccagcaggtccggagcctcatcgggaacgaggagttcctggactacatgccctccatgaagcgcttccggaaggaggaggagagcgagggcgccatctggtga

SEQ ID NO: 9893 - RNA, 9873 nt, synthetic construct
  misc_feature 1..9873: note = derived and/or modified CDS sequence (opt1) from DENV-3__GU131862__SS-prME
  source 1..9873: mol_type = other RNA
accagcctgtgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgatcaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcgggatcctcctgacgtggatcggcctgaacagcaagaacacctccatgagcttctcctgcatcgccatcgggatcatcaccctctacctgggcgccgtggtgcaggcggacatcgggtgcgtcatcaactggaagggcaaggagctgaagtgcggcagcgggatcttcgtgaccaacgaggtgcacacgtggaccgagcagtacaagttccaggccgactcccccaagcggctcgccaccgccatcgccggcgcgtgggagaacggggtctgcggcatccgcagcaccacgcggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacgtgggggaaggccaagatcgtgaccgccgagacccagaacagctccttcatcatcgacggccccaacacccccgagtgccccagcgcgtcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcacgttcgtgctgctcctgtccggccagatcacctggcgcgacatgacccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatgttcaccctgaccgtggcctggcgcacggccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacaccctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcacggggacctccgccgacctgaccgtggagaaggcggccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcgtgttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcatccgggaggccatcaagcgccggctccgcacgctgatcctggcccccacccgggtcgtggccgccgagatggaggaggcgctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgcggcccgcgggtacatcagcacccgcgtgggcatgggcgaggccgccgcgatcttcatgaccgccacgccgcccgggacggccgacgccttcccgcagtccaacgcccccatccaggacgaggagcgggacatccccgagcgcagctggaactccggcaacgagtggatcaccgacttcgtcgggaagaccgtgtggttcgtgcccagcatcaaggcgggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccgctggctggacgcccggacctactccgacccgctggccctcaaggagttcaaggacttcgccgcgggccgcaagagcatcacgctggacctggtgaccgagatcgggcgggtgccctcccacctcgcccaccgcacccggaacgccctggacaacctggtcatgctccacaccagcgagcacggcgggcgcgcctaccggcacgccgtggaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtcctggagttcttcatgatggtgctcctgatccccgagcccgagaagcagcgcacgccccaggacaaccagctggcgtacgtggtcatcgggatcctcaccctggccgccatcatcgccgccaacgagatgggcctgctcgagaccaccaagcgggacctgggcatgtccaaggagccgggggtggtgagccccaactcctacctggacgtcgacctccaccccgcgagcgcctggacgctgtacgccgtggccaccaccgtgatcacccccatgctgcgccacacgatcgagaactccaccgcgaacgtcagcctcgccgccatcgccaaccaggccgtggtgctgatgggcctggacaaggggtggccgatctccaagatggacctcggcgtccccctgctggcgctcgggtgctacagccaggtgaaccccctgaccctgaccgccgccgtgctcctgctgatcacgcactacgccatcatcggccccggcctccaggccaaggcgacccgggaggcccagaagcgcaccgccgccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggcgctctgcgaggccctgaccctggccaccggccccatcacgaccctctgggagggctcccccgggaagttctggaacaccaccatcgccgtgagcatggcgaacatcttccgcggctcctacctggccggggccggcctggccttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccggaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgcggagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgcggagtggctctggaagaccctggggcggaacaagaagccccgcctgtgcacgcgcgaggagttcaccaagaaggtccggaccaacgccgccatgggcgccgtgttcaccgaggagaaccagtgggactccgcgaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacacggccgggtgggacacccggatcaccgaggacgacctgcacaacgaggagaagatcacccagcagatggacccggagcaccgccagctcgcgaacgccatcttcaagctgacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcccagctcatccgccagatggagggcgagggggtgctgagcaaggccgacctggagaacccccacctcccggagaagaagatcacccagtggctggagaccaagggcgtcgagcggctgaagcgcatggccatctccggcgacgactgcgtggtgaagcccatcgacgaccggttcgcgaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctccgcgagacggcgtgcctgggcaaggcctacgcccagatgtggagcctgatgtacttccaccggcgcgacctccggctggcctccaacgcgatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggccacctgggcccagaacatcccgacggcgatccagcaggtccgcagcctcatcggcaacgaggagttcctggactacatgccctccatgaagcggttccgcaaggaggaggagagcgagggggccatctggtga

SEQ ID NO: 9894 - RNA, 9873 nt, synthetic construct
  misc_feature 1..9873: note = derived and/or modified CDS sequence (opt1) from DENV-3__GU131865__SS-prME
  source 1..9873: mol_type = other RNA
accagcctctgcctcgtgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcatccgggaggccatcaagcgccggctccgcaccctgatcctggcccccacccgggtcgtggccgccgagatggaggaggcgctcaaggggctgcccatccgctaccagacgaccgtgaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgccgcgcgcgggtacatcagcacccgcgtcggcatgggcgaggccgccgccatcttcatgacggcgacgccgcccgggaccgccgacgccttcccgcagtccaacgcccccatccaggacgaggagcgggacatccccgagcgcagctggaactccggcaacgagtggatcaccgacttcgccgggaagacggtgtggttcgtgcccagcatcaaggcgggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccgctggctggacgcccggacctactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcggtcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccacgaagcgggacctgggcatgtccaaggagccgggggtggtcagccccacctcctacctggacgtggacctccaccccgccagcgcctggaccctgtacgccgtggcgaccacggtcatcacccccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgggaggcccagaagcgcacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgacgctggccaccggccccatcaccaccctctgggagggctcccccgggaagttctggaacacgaccatcgcggtcagcatggccaacatcttccgcggctcctacctggccggggccggcctggccttcagcatcatgaagtccgtggggaccggcaagcggggcaccgggagccagggcgagaccctcggggagaagtggaagcgcaagctgaaccagctgagccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcgcggcgggtggagctactactgcgccggcctgaagaaggtgaccgaggtgcggggctacacgaagggcgggcccgggcacgaggagcccgtccccatgtccacctacggctggaacatcgtgaagctgatgaccgggaaggacgtgttctacctcccgcccgagaagtgcgacaccctgctgtgcgacatcggcgagagctcccccagccccacggtcgaggagtcccgcaccatccgggtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcacggggaacatcgtcgcctccgtgaacatggtgagccgcctcctgctgaaccggttcaccatgacccaccgccggccgaccatcgagaaggacgtcgacctcggcgcgggcacgcgccacgtgaacgccgagcccgagacccccaacatggacgtgatcggggagcggatcaagcgcatcaaggaggagcacaactccacctggcactacgacgacgagaacccgtacaagacctgggcctaccacggcagctacgaggtcaaggccacggggtccgccagctccatgatcaacggcgtggtcaagctgctgaccaagccctgggacgtggtgcccatggtcacccagatggcgatgaccgacacgacccccttcgggcagcagcgggtgttcaaggagaaggtggacacccgcaccccgcggagcatgcccggcacgcgccgggtcatggagatcaccgccgagtggctctggcgcaccctgggccgcaacaagaagccccggctgtgcacccgcgaggagttcacgaagaaggtgcggaccaacgccgccatgggggcggtgttcaccgaggagaaccagtgggacagcgccaaggccgccgtcgaggacgaggacttctggaagctcgtggaccgcgagcgggagctgcacaagctgggcaagtgcgggtcctgcgtgtacaacatgatgggcaagcgcgagaagaagctcggggagttcggcaaggccaagggcagccgggcgatctggtacatgtggctgggggcccgctacctggagttcgaggccctcggcttcctgaacgaggaccactggttctcccgggagaacagctactccggggtcgagggcgaggggctgcacaagctcggctacatcctgcgcgacatcagcaagatccccggcggggccatgtacgccgacgacaccgcgggctgggacacgcggatcaccgaggacgacctgcacaacgaggagaagatcacccagcagatggacccggagcaccgccagctcgccaacgccatcttcaagctgacctaccagaacaaggtggtgaaggtccagcggcccacccccacggggaccgtgatggacatcatctcccgcaaggaccagcggggcagcggccaggtggggacctacggcctgaacaccttcacgaacatggaggtccagctcatccgccagatggagggggagggcgtgctgtccaaggccgacctggagaacccccacctcccggagaagaagatcacccagtggctggagaccaagggggtggagcggctgaagcgcatggccatcagcggcgacgactgcgtcgtgaagcccatcgacgaccggttcgcgaacgccctcctggccctgaacgacatgggcaaggtgcgcaaggacatcccccagtggcagccctccaaggggtggcacgactggcagcaggtcccgttctgcagccaccacttccacgagctcatcatgaaggacggccggaagctggtggtgccctgccgcccccaggacgagctgatcgggcgcgcccggatctcccagggcgccgggtggagcctccgcgagaccgcgtgcctgggcaaggcctacgcccagatgtggtccctgatgtacttccaccggcgcgacctccggctggccagcaacgcgatctgctccgccgtccccgtgcactgggtgccgacgagccgcaccacctggtccatccacgcccaccaccagtggatgaccacggaggacatgctgaccgtctggaaccgggtgtggatcgaggacaacccctggatggaggacaagacccccgtgaccacgtgggagaacgtcccctacctcggcaagcgcgaggaccagtggtgcgggagcctgatcggcctgaccagccgggccacctgggcccagaacatcccgaccgcgatccagcaggtccgctccctcatcgggaacgaggagttcctggactacatgcccagcatgaagcggttccgcaaggaggaggagtccgagggcgccatctggtga

SEQ ID NO: 9895 - RNA, 9873 nt, synthetic construct
  misc_feature 1..9873: note = derived and/or modified CDS sequence (opt1) from DENV-3__GU131866__SS-prME
  source 1..9873: mol_type = other RNA
accagcctgtgcctgatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggaccgccggtccgtggccctcgcgccccacgtgggcatggggctggacacccgcacccagacctggatgagcgccgagggcgcctggcgccaggtggagaaggtggagacgtgggccctgcgccaccccgggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctgcccgagtacggcaccctcgggctggagtgcagcccccggaccggcctggacttcaacgagatgatcctcctgacgatgaagaacaaggcctggatggtgcaccggcagtggttcttcgacctgccgctcccctggaccagcggcgccaccaccgagacgcccacctggaaccgcaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccggctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccctgcaagatcccgttcagcaccgaggacgggcagggcaaggcccacaacggccgcctgatcacggccaaccccgtcgtgaccaagaaggaggagcccgtgaacatcgaggccgagcccccgttcggggagagcaacatcgtcatcggcatcggggacaacgcgctgaagatcaactggtacaagaagggctccagcatcgggaagatgttcgaggccaccgcccggggcgcccgccgcatggccatcctcggcgacaccgcgtgggacttcgggtccgtgggcggggtgctgaacagcctgggcaagatggtccaccagatcttcgggtccgcctacacggccctcttcagcggcgtgtcctgggtgatgaagatcggcatcggggtcctgctgacctggatcggcctcaacagcaagaacacctccatgagcttctcctgcatcgccatcgggatcatcaccctgtacctgggcgccgtggtgcaggcggacatggggtgcgtcatcaactggaagggcaaggagctcaagtgcggcagcgggatcttcgtgacgaacgaggtgcacgcctggaccgagcagtacaagttccaggccgactcccccaagcggctggccaccgccatcgcgggcgcctgggagaacggggtctgcggcatccgcagcaccacgcggatggagaacctgctctggaagcagatcgccaacgagctgaactacatcctgtgggagaacaacatcaagctcaccgtggtggtcggggacatcatcggcgtgctggagcagggcaagcgcaccctgacgccccagcccatggagctcaagtactcctggaagacgtgggggaaggccaagatcgtgaccgcggagacccagaacagctccttcatcatcgacggcccgaacacccccgagtgccccagcgcctcccgggcctggaacgtctgggaggtggaggactacgggttcggcgtgttcacgaccaacatctggctgaagctgcgcgaggtctacacccagctctgcgaccaccggctgatgagcgccgccgtgaaggacgagcgcgcggtgcacgccgacatgggctactggatcgagagccagaagaacgggtcctggaagctggagaaggccagcctcatcgaggtcaagacctgcacctggcccaagtcccacacgctgtggagcaacggcgtgctggagtccgacatgatcatccccaagtccctcgccgggcccatctcccagcacaaccaccggcccggctaccacacccagaccgccgggccgtggcacctgggcaagctggagctcgacttcaactactgcgagggcaccacggtggtcatcaccgagaactgcgggacccgcggccccagcctgcggaccacgaccgtgtccgggaagctgatccacgagtggtgctgccgcagctgcaccctgccgcccctccggtacatgggcgaggacgggtgctggtacggcatggagatccgcccgatctccgagaaggaggagaacatggtcaagagcctggtctccgcgggcagcgggaaggtggacaacttcaccatgggcgtgctctgcctggccatcctgttcgaggaggtcatgcgggggaagttcggcaagaagcacatgatcgccggggtgttcttcacgttcgtgctcctgctgtccggccagatcacctggcgcgacatggcccacaccctcatcatgatcggcagcaacgcctccgaccggatggggatgggcgtcacctacctggcgctgatcgccacgttcaagatccagcccttcctcgccctggggttcttcctgcgcaagctcaccagccgggagaacctgctgctcggcgtgggcctggccatggcgaccaccctgcagctccccgaggacatcgagcagatggccaacgggatcgccctgggcctgatggccctcaagctgatcacgcagttcgagacctaccagctgtggaccgccctcatcagcctgacctgctccaacacgatgttcaccctgaccgtggcgtggcgcaccgccacgctcatcctggccggggtcagcctgctccccgtgtgccagtccagctccatgcgcaagaccgactggctgccgatggccgtcgccgcgatgggcgtgccgcccctgcccctcttcatcttcagcctgaaggacaccctgaagcggcgctcctggccgctcaacgagggggtgatggccgtcggcctggtgagcatcctggcctccagcctcctgcggaacgacgtgcccatggccggccccctggtcgccgggggcctcctgatcgcgtgctacgtgatcaccgggacgtccgccgacctgaccgtggagaaggccgccgacatcacctgggaggaggaggccgagcagaccggcgtcagccacaacctcatgatcacggtggacgacgacgggaccatgcgcatcaaggacgacgagaccgagaacatcctgaccgtgctgctcaagaccgcgctgctgatcgtctccggcgtgttcccctacagcatcccggccacgctcctggtgtggcacacctggcagaagcagacccagcggtccggcgtcctgtgggacgtgccctccccgcccgagacccagaaggccgagctcgaggagggggtgtaccgcatcaagcagcagggcatcttcgggaagacgcaggtcggcgtgggggtgcagaaggagggcgtcttccacaccatgtggcacgtgacccggggcgccgtgctgacctacaacgggaagcgcctggagccgaactgggcgtccgtcaagaaggacctcatcagctacggcgggggctggcggctgtccgcccagtggcagaagggggaggaggtccaggtgatcgccgtcgagcccggcaagaaccccaagaacttccagacgatgcccggcaccttccagaccaccacgggggagatcggcgccatcgccctggacttcaagccggggaccagcggcagccccatcatcaaccgcgagggcaaggtggtggggctgtacggcaacggggtcgtgaccaagaacggcgggtacgtgtccggcatcgcgcagaccaacgccgagcccgacggcccgacgcccgagctcgaggaggagatgttcaagaagcggaacctgaccatcatggacctgcaccccgggagcggcaagacccgcaagtacctccccgccatcgtccgggaggccatcaagcgccggctgcgcaccctgatcctcgccccgacgcgggtggtggcggccgagatggaggaggccctgaaggggctgcccatccgctaccagaccaccgccaccaagtccgagcacacgggccgggagatcgtcgacctcatgtgccacgccaccttcaccatgcgcctgctgagccccgtgcgggtgcccaactacaacctcatcatcatggacgaggcgcacttcaccgacccggcctccatcgccgcccgcgggtacatcagcacgcgcgtcggcatgggcgaggcggccgccatcttcatgaccgccacgccgcccgggaccgccgacgcgttcccccagtccaacgccccgatccaggacgaggagcgggacatccccgagcgcagctggaactccggcaacgagtggatcacggacttcgccgggaagaccgtgtggttcgtgcccagcatcaaggccggcaacgacatcgccaactgcctgcggaagaacgggaagaaggtcatccagctgtcccgcaagaccttcgacaccgagtaccagaagacgaagctcaacgactgggacttcgtggtgaccaccgacatcagcgagatgggcgcgaacttcaaggccgaccgggtcatcgacccccgccggtgcctgaagccggtgatcctgaccgacggccccgagcgcgtgatcctcgccgggcccatgcccgtcacggccgcctccgcggcccagcggcgcggccgggtggggcgcaacccgcagaaggagaacgaccagtacatcttcaccggccagcccctgaacaacgacgaggaccacgcccactggaccgaggccaagatgctgctcgacaacatcaacacccccgaggggatcatccccgcgctgttcgagccggagcgggagaagtccgccgccatcgacggcgagtaccgcctgaagggcgagtcccggaagaccttcgtggagctcatgcgccgcggggacctgcccgtctggctggcccacaaggtggccagcgagggcatcaagtacacggaccgcaagtggtgcttcgacgggcagcggaacaaccagatcctcgaggagaacatggacgtcgagatctggaccaaggagggcgagaagaagaagctgcgcccccgctggctggacgcgcggacctactccgaccccctcgccctgaaggagttcaaggacttcgccgccggccgcaagagcatcgccctggacctcgtgaccgagatcgggcgggtgccgtcccacctggcgcaccgcacgcggaacgccctggacaacctcgtcatgctgcacaccagcgagcacggcgggcgcgcctaccggcacgccgtggaggagctgcccgagaccatggagaccctcctgctgctcggcctgatgatcctgctcaccggcggggccatgctgttcctgatcagcgggaaggggatcggcaagacctccatcgggctcatctgcgtgatcgcgagctccggcatgctgtggatggccgagatccccctgcagtggatcgccagcgccatcgtcctcgagttcttcatgatggtgctgctgatcccggagcccgagaagcagcgcacgccccaggacaaccagctcgcctacgtggtcatcgggatcctgaccctggcggccatcatcgccgccaacgagatgggcctcctggagacgaccaagcgggacctgggcatgtccaaggagcccggggtggtgagcccgacctcctacctcgacgtcgacctgcaccccgcgagcgcctggaccctgtacgccgtggccacgaccgtgatcacccccatgctccgccacaccatcgagaactccacggccaacgtcagcctggcggccatcgccaaccaggccgtggtgctgatgggcctcgacaaggggtggcccatctccaagatggacctgggcgtcccgctgctcgccctggggtgctacagccaggtgaaccccctgaccctcaccgcggccgtgctgctgctcatcacccactacgccatcatcggccccggcctgcaggccaaggccacgcgggaggcgcagaagcgcaccgccgccgggatcatgaagaaccccaccgtcgacggcatcatgaccatcgacctggacccggtgatctacgactccaagttcgagaagcagctcggccaggtgatgctgctggtcctctgcgccgtgcagctgctgctcatgcggacgagctgggcgctgtgcgaggccctgaccctcgccaccggccccatcaccacgctgtgggagggctcccccgggaagttctggaacaccaccatcgccgtgagcatggccaacatcttccgcggctcctacctggcgggggccggcctcgccttcagcatcatgaagtccgtcgggaccggcaagcggggcacggggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagatcacccaccacgccgtgagccggggctccgcgaagctccagtggttcgtcgagcgcaacatggtgatccccgaggggcgggtgatcgacctgggctgcgggcgcggcgggtggagctactactgcgccggcctgaagaaggtcacggaggtgcgcggctacaccaagggcgggccggggcacgaggagcccgtgcccatgtccacctacggctggaacatcgtcaagctcatgagcgggaaggacgtgttctacctgcccccggagaagtgcgacaccctgctgtgcgacatcggcgagtccagcccctcccccacggtggaggagagccggaccatccgcgtcctcaagatggtggagccctggctgaagaacaaccagttctgcatcaaggtgctgaacccgtacatgcccaccgtcatcgagcacctcgagcggctgcagcgcaagcacggcgggatgctggtgcggaaccccctctcccgcaacagcacccacgagatgtactggatctccaacggcacggggaacatcgtggccagcgtcaacatggtgtcccggctgctgctcaaccgcttcaccatgacccaccggcgccccaccatcgagaaggacgtggacctgggcgccggcacgcggcacgtcaacgccgagccggagacccccaacatggacgtgatcggggagcgcatcaagcggatcaaggaggagcacaacagcacctggcactacgacgacgagaacccctacaagacctgggcgtaccacggctcctacgaggtgaaggccacggggagcgcctccagcatgatcaacggcgtcgtgaagctgctcaccaagccgtgggacgtcgtgcccatggtgacccagatggccatgaccgacacgacccccttcgggcagcagcgcgtcttcaaggagaaggtggacacccggacgccccgcagcatgccgggcacccggcgcgtgatgggcatcaccgcggagtggctgtggcggaccctggggcgcaacaagaagccccgcctctgcacccgggaggagttcacgaagaaggtccgcaccaacgccgccatgggcgccgtgttcaccgaggagaaccagtgggactccgccaaggcggccgtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgccatctggtacatgtggctgggcgcccggtacctcgagttcgaggcgctggggttcctgaacgaggaccactggttcagccgcgagaactcctacagcggcgtggagggggagggcctccacaagctgggctacatcctgcgggacatctccaagatccccgggggcgccatgtacgccgacgacaccgccgggtgggacacgcgcatcaccgaggacgacctccacaacgaggagaagatcacccagcagatggaccccgagcaccggaagctggccaacgcgatcttcaagctgacctaccagaacaaggtcgtgaaggtgcagcgcccgacgcccaccggcaccgtcatggacatcatcagccggaaggaccagcgcggctccggccaggtgggcacctacgggctcaacaccttcacgaacatggaggcccagctgatccggcagatggagggcgagggggtgctgagcaaggccgacctcgagaacccccacctccccgagaagaagatcacccagtggctggagaccaagggcgtcgagcgcctcaagcggatggccatctccggcgacgactgcgtggtgaagccgatcgacgaccgcttcgccaacgcgctgctggccctcaacgacatggggaaggtccggaaggacatcccccagtggcagcccagcaagggctggcacgactggcagcaggtccccttctgctcccaccacttccacgagctgatcatgaaggacgggcgcaagctggtggtcccgtgccggccccaggacgagctcatcggccgcgcccgcatcagccagggggccggctggtccctgcgggagaccgcgtgcctgggcaaggcctacgcccagatgtggagcctcatgtacttccaccgccgggacctgcgcctggcctccaacgccatctgcagcgcggtgcccgtgcactgggtccccacgtcccggaccacctggagcatccacgcccaccaccagtggatgaccacggaggacatgctcaccgtgtggaaccgcgtgtggatcgaggacaacccgtggatggaggacaagacccccgtcaccacgtgggagaacgtgccctacctggggaagcgggaggaccagtggtgcggcagcctgatcgggctcacctcccgcgccacctgggcccagaacatccccaccgccatccagcaggtccggagcctgatcggcaacgaggagttcctggactacatgccgtccatgaagcgcttccggaaggaggaggagagcgagggggcgatctggtga

SEQ ID NO: 9896 - RNA, 9873 nt, synthetic construct
  misc_feature 1..9873: note = derived and/or modified CDS sequence (opt1) from DENV-3__GU131868__SS-prME
  source 1..9873: mol_type = other RNA
acgcccctgtgcctcatgatgatcctgccggccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcggcgggacaagcgcagcgtggccctcgcgccgcacgtgggcatggggctggacacccggacccagacctggatgagcgccgagggcgcctggcgccaggtggagaaggtggagacgtgggccctgcggcaccccgggttcaccatcctcgcgctgttcctggcccactacatcggcaccagcctcacccagaaggtggtgatcttcatcctgctgatgctcgtcacgccctccatgaccatgcgctgcgtgggggtgggcaaccgggacttcgtcgagggcctgagcggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgactcccggtgcccgacgcagggcgaggccgtgctgcccgaggagcaggaccagaactacgtctgcaagcacacctacgtggaccgcgggtggggcaacgggtgcggcctcttcgggaagggcagcctggtgacctgcgccaagttccagtgcctggagctcatcgagggcaaggtcgtgcagtacgagaacctgaagtacaccgtgatcatcacggtccacaccggggaccagcaccaggtgggcaacgagacccagggggtcaccgccgagatcacgccccaggcctccaccaccgaggcgatcctgcccgagtacggcaccctcgggctggagtgcagcccgcggaccggcctggacttcaacgagatgatcctcctgacgatgaagaacaaggcctggatggtgcaccgccagtggttcttcgacctgcccctcccctggacctccggcgccaccaccgagacgcccacctggaaccggaaggagctgctggtgaccttcaacaacgcccacgccaagaagcaggaggtcgtggtgctcgggagccaggagggcgcgatgcacaccgccctgacgggggccaccgagatccagaactccggcgggaccagcatcttcgccggccacctgaagtgccgcctcaagatggacaagctggagctgaagggcatgtcctacgccatgtgcaccaacacgttcgtcctcaagaaggaggtgagcgagacccagcacgggaccatcctgatcaaggtggagtacaagggcgaggacgcgccgtgcaagatccccttctccaccgaggacgggcagggcaaggcccacaacggccggctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggcagctccatcgggaagatgttcgaggccaccgcccgcggcgcccggcgcatggccatcctcggcgacaccgcgtgggacttcgggagcgtgggcggggtgctgaactccctgggcaagatggtccaccagatcttcgggagcgcctacacggccctcttctccggcgtgagctgggtgatgaagatcggcatcggggtcctgctgacctggatcggcctcaactccaagaacaccagcatgtccttcagctgcatcgccatcgggatcatcaccctgtacctgggcgccgtggtgcaggcggacatggggtgcgtcatcaactggaagggcaaggagctcaagtgcggctccgggatcttcgtgacgaacgaggtgcacacctggaccgagcagtacaagttccaggccgacagccccaagcgcctggccaccgccatcgccggcgcgtgggagaacggggtctgcggcatccggtccacgacccgcatggagaacctgctctggaagcagatcgccaacgagctgaactacatcctgtgggagaacaacatcaagctcaccgtggtggtcggggacatcatcggcgtgctggagcagggcaagcggaccctgacgccccagccgatggagctcaagtacagctggaagacctgggggaaggccaagatcgtgaccgccgagacccagaactccagcttcatcatcgacggccccaacacgcccgagtgcccctccgcgagccgcgcctggaacgtctgggaggtggaggactacgggttcggcgtgttcaccaccaacatctggctgaagctgcgggaggtctacacccagctctgcgaccaccgcctgatgtccgccgccgtgaaggacgagcgggccgtgcacgcggacatgggctactggatcgagagccagaagaacgggagctggaagctggagaaggcctccctcatcgaggtcaagacctgcacgtggcccaagagccacaccctgtggtccaacggcgtgctggagagcgacatgatcatccccaagtccctcgccgggcccatcagccagcacaaccaccgcccgggctaccacacccagaccgccgggccctggcacctgggcaagctggagctcgacttcaactactgcgagggcacgaccgtggtcatcaccgagaactgcgggacccggggcccctccctgcgcacgaccaccgtgagcgggaagctgatccacgagtggtgctgccggtcctgcaccctgccgcccctgcgctacatgggcgaggacgggtgctggtacggcatggagatccggcccatcagcgagaaggaggagaacatggtgaagtccctggtcagcgccggctccgggaaggtggacaacttcacgatgggcgtgctctgcctggcgatcctgttcgaggaggtcatgcgcgggaagttcggcaagaagcacatgatcgccggggtgttcttcaccttcgtgctcctgctgagcggccagatcacctggcgggacatggcccacaccctcatcatgatcggctccaacgccagcgaccgcatggggatgggcgtcacgtacctggccctgatcgcgaccttcaagatccagcccttcctcgccctggggttcttcctgcggaagctcacctcccgcgagaacctgctgctcggcgtgggcctggccatggccaccacgctgcagctccccgaggacatcgagcagatggcgaacgggatcgccctgggcctgatggccctcaagctgatcacccagttcgagacctaccagctgtggaccgccctcatcagcctgacgtgcagcaacaccatgttcaccctgaccgtggcctggcggacggcgaccctcatcctggccggggtctccctgctcccggtgtgccagagctccagcatgcgcaagaccgactggctgcccatggccgtcgccgccatgggcgtgccgcccctccccctcttcatcttctccctgaaggacaccctgaagcgccggagctggcccctcaacgagggggtgatggcggtcggcctggtgtccatcctggccagctccctcctgcgcaacgacgtgcccatggccggccccctggtcgccgggggcctcctgatcgcctgctacgtgatcacggggaccagcgcggacctgaccgtggagaaggccgccgacatcacctgggaggaggaggccgagcagacgggcgtctcccacaacctcatgatcaccgtggacgacgacgggaccatgcggatcaaggacgacgagaccgagaacatcctgaccgtgctgctcaagacggccctgctgatcgtcagcggcgtgttcccgtactccatccccgcgaccctcctggtgtggcacacctggcagaagcagacccagcgcagcggcgtcctgtgggacgtgcccagcccgcccgagacgcagaaggccgagctcgaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctggagcccaactgggccagcgtcaagaaggacctcatctcctacggcgggggctggcgcctgagcgcgcagtggcagaagggggaggaggtccaggtgatcgccgtcgagcccggcaagaaccccaagaacttccagaccatgccgggcaccttccagaccacgaccggggagatcggcgccatcgccctggacttcaagcccgggacctccggcagccccatcatcaaccgggagggcaaggtggtggggctgtacggcaacggggtcgtgaccaagaacggcgggtacgtgagcggcatcgcccagacgaaggcggagccggacggccccacccccgagctcgaggaggagatgttcaagaagcgcaacctgaccatcatggacctgcaccccgggtccggcaagacccggaagtacctcccggccatcgtccgcgaggccatcaagcggcgcctgcggacgctgatcctcgcccccacccgcgtggtggccgcggagatggaggaggccctgaaggggctgcccatccggtaccagaccaccgccaccaagtccgagcacaccggccgcgagatcgtcgacctcatgtgccacgccaccttcaccatgcggctgctgtcccccgtgcgcgtgccgaactacaacctcatcatcatggacgaggcccacttcacggaccccgcgagcatcgccgcccgggggtacatctccacccgcgtcggcatgggcgaggccagcgcgatcttcatgaccgccacgccgcccgggacggccgacgccttcccgcagtccaacgcccccatccaggacgaggagcgcgacatccccgagcggagctggaactccggcaacgagtggatcaccgacttcgcggggaagaccgtgtggttcgtgcccagcatcaaggccggcaacgacatcgccaactgcctgcgcaagaacgggaagaaggtcatccagctgtcccggaagaccttcgacacggagtaccagaagaccaagctcaacgactgggacttcgtggtgaccaccgacatcagcgagatgggcgccaacttcaaggccgaccgcgtcatcgacccgcggcgctgcctgaagcccgtgatcctgacggacggccccgagcgggtgatcctcgcggggcccatgccggtcaccgccgcctccgccgcccagcgccggggccgcgtggggcggaacccccagaaggagaacgaccagtacatcttcaccggccagcccctgaacaacgacgaggaccacgcgcactggaccgaggccaagatgctgctcgacaacatcaacacccccgaggggatcatcccggccctgttcgagcccgagcgcgagaagtccgccgcgatcgacggcgagtaccggctgaagggcgagtcccgcaagacgttcgtggagctcatgcggcgcggggacctgcccgtctggctggcccacaaggtggccagcgagggcatcaagtacaccgaccggaagtggtgcttcgacgggcagcgcaacaaccagatcctcgaggagaacatggacgtcgagatctggaccaaggagggcgagaagaagaagctgcggccccgctggctggacgcccgcacctactccgacccgctcgccctgaaggagttcaaggacttcgcggccggccgcaagagcatcgccctggacctcgtgacggagatcgggcgcgtgccctcccacctggcccaccggacccgcaacgccctggacaacctcgtcatgctgcacaccagcgagcacggcgggcgggcgtaccgccacgccgtggaggagctgcccgagaccatggagacgctcctgctgctcggcctgatgatcctgctcaccgggggcgccatgctgttcctgatcagcggcaaggggatcggcaagacctccatcgggctcatctgcgtgatcgccagctccggcatgctgtggatggccgagatcccgctgcagtggatcgcgagcgccatcgtcctcgagttcttcatgatggtgctgctgatccccgagcccgagaagcagcggacgccccaggacaaccagctcgcctacgtggtcatcgggatcctgacgctggccgccatcatcgcggccaacgagatgggcctcctggagaccaccaagcgcgacctgggcatgtccaaggagccgagcgtggtgtcccccaccagctacctcgacgtcgacctgcaccccgcctccgcctggacgctgtacgcggtggccaccaccgtgatcacccccatgctccggcacacgatcgagaacagcaccgccaacgtctccctggccgccatcgcgaaccaggccgtggtgctgatggggctcgacaagggctggccgatcagcaagatggacctgggggtccccctgctcgccctgggctgctactcccaggtgaaccccctgaccctcaccgccgccgtgttcctgctgatcacgcactacgcgatcatcgggcccggcctccaggccaaggccacccgcgaggcccagaagcggaccgccgcgggcatcatgaagaacccgaccgtcgacgggatcatgacgatcgacctggaccccgtgatctacgacagcaagttcgagaagcagctgggccaggtgatgctcctggtcctgtgcgccgtgcagctcctgctgatgcgcacctcctgggccctctgcgaggccctgaccctggcgaccgggcccatcacgaccctctgggagggcagccccggcaagttctggaacaccaccatcgccgtgtccatggccaacatcttccgggggagctacctggccggcgccgggctggcgttctccatcatgaagtccgtcggcacggggaagcgcggcaccggcagccagggggagaccctcggcgagaagtggaagaagaagctgaaccagctgtcccggaaggagttcgacctctacaagaagtccgggatcaccgaggtggaccgcaccgaggccaaggagggcctgaagcgcggggagatcacgcaccacgccgtgtcccgcggcagcgccaagctgcagtggttcgtcgagcggaacatggtgatcccggagggccgcgtgatcgacctcgggtgcggccgcgggggctggtcctactactgcgccgggctgaagaaggtcaccgaggtgcgcggctacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggggagagctcccccagccccaccgtggaggagtcccgcaccatccgggtcctgaagatggtggagccgtggctcaagaacaaccagttctgcatcaaggtgctgaacccctacatgcccaccgtcatcgagcacctggagcgcctccagcggaagcacggcggcatgctggtgcgcaaccccctgagccggaactccacgcacgagatgtactggatcagcaacgggaccggcaacatcgtggcgtccgtcaacatggtgagccgcctcctgctgaaccggttcaccatgacccaccgccggccgacgatcgagaaggacgtggacctcggggccggcacccgccacgtcaacgccgagcccgagacccccaacatggacgtgatcggcgagcggatcaagcgcatcaaggaggagcacaactccacctggcactacgacgacgagaacccgtacaagacgtgggcctaccacgggagctacgaggtgaaggccaccggctccgcgagcagcatgatcaacggggtcgtgaagctgctgaccaagccctgggacgtcgtgcccatggtgacccagatggccatgacggacaccacccccttcggccagcagcgggtcttcaaggagaaggtggacacccgcacgccgcggtccatgcccgggacccgccgggtgatgggcatcaccgccgagtggctctggcgcaccctgggccggaacaagaagccccgcctgtgcacgcgcgaggagttcaccaagaaggtccggaccaacgccgcgatgggggccgtgttcaccgaggagaaccagtgggacagcgccaaggccgccgtggaggacgaggacttctggaagctcgtcgaccgcgagcgggagctgcacaagctgggcaagtgcgggtcctgcgtgtacaacatgatgggcaagcgcgagaagaagctcggggagttcggcaaggcgaagggcagccgggccatctggtacatgtggctgggggcccgctacctggagttcgaggccctcggcttcctgaacgaggaccactggttctcccgggagaacagctactccggggtggagggcgaggggctgcacaagctcggctacatcctgcgcgacatcagcaagatccccggcggggccatgtacgcggacgacacggccggctgggacacccggatcaccgaggacgacctgcacaacgaggagaagatcacccagcagatggacccggagcaccgccagctcgccaacgccatcttcaagctgacgtaccagaacaaggtcgtgaaggtgcagcggcccacccccaccgggaccgtcatggacatcatctcccgcaaggaccagcggggcagcggccaggtggggacctacggcctgaacacgttcaccaacatggaggcccagctcatccgccagatggagggggagggcgtgctgtccaaggcggacctggagaacccccacctcccggagaagaagatcacccagtggctggagaccaagggggtcgagcggctgaagcgcatggccatcagcggcgacgactgcgtggtgaagcccatcgacgaccggttcgccaacgccctcctggccctgaacgacatgggcaaggtccgcaaggacatcccccagtggcagccctccaaggggtggcacgactggcagcaggtcccgttctgcagccaccacttccacgagctcatcatgaaggacggccggaagctggtggtcccctgccgcccccaggacgagctgatcgggcgggcgcgcatctcccagggcgccgggtggagcctccgcgagacggcctgcctgggcaaggcctacgcgcagatgtggtccctgatgtacttccaccggcgcgacctccggctggccagcaacgccatctgctccgccgtgcccgtgcactgggtcccgaccagccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcggcaagcgcgaggaccagtggtgcgggtccctgatcggcctgaccagccgggcgacctgggcccagaacatcccgacggccatccagcaggtccgctccctcatcgggaacgaggagttcctggactacatgcccagcatgaagcggttccgcaaggaggaggagtccgagggcgccatctggtga

SEQ ID NO: 9897 - RNA, 9873 nt, synthetic construct
  misc_feature 1..9873: note = derived and/or modified CDS sequence (opt1) from DENV-3__GU131869__SS-prME
  source 1..9873: mol_type = other RNA
accagcctgtgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacatcgcgtgggacttcgggtccgtgggcggggtcctcaacagcctgggcaagatggtgcaccagatcttcgggtccgcctacaccgccctgttcagcggcgtgtcctgggtcatgaagatcggcatcgggatcctcctgacgtggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacgtggaccgagcagtacaagttccaggccgactcccccaagcggctcgccaccgccatcgccggcgcgtgggagaacggggtctgcggcatccgcagcaccacgcggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacgtgggggaaggccaagatcgtgaccgccgagacccagaacagctccttcatcatcgacggccccaacacccccgagtgccccagcgcgtcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcacgttcgtgctgctcctgtccggccagatcacctggcgcgacatgacccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatgttcaccctgaccgtggcctggcgcacggccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacaccctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcacggggacctccgccgacctgaccgtggagaaggcggccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcgtgttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcatccgggaggccatcaagcgccggctccgcaccctgatcctggcccccacccgggtcgtggccgccgagatggaggaggcgctcaaggggctgcccatccgctaccagaccacggccacccggtccgagcacaccggccgcgagatcgtggacctgatgtgccacgccaccttcacgatgcggctcctgagccccgtccgcgtgccgaactacaacctgatcatcatggacgaggcccacttcaccgaccccgcctccatcgcggcccgcgggtacatcagcacccgggtgggcatgggcgaggccgccgcgatcttcatgaccgccacgccgcccgggaccgccgacgccttcccgcagtccaacgcccccatccaggacgaggagcgcgacatccccgagcggagctggaactccggcaacgagtggatcaccgacttcgcggggaagaccgtctggttcgtgcccagcatcaaggccggcaacgacatcgccaactgcctccgcaagaacgggaagaaggtgatccagctgtcccggaagacgttcgacaccgagtaccagaagaccaagctgaacgactgggacttcgtcgtgaccacggacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggaccaaggagggcgagaagaagaagctccgcccccggtggctggacgcccgcacgtactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacaccagcgagcacggcgggcgggcgtaccgccacgccgtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccaccaagcgcgacctgggcatgtccaaggagccgggggtcgtgagccccacgtcctacctggacgtggacctccaccccgccagcgcctggaccctgtacgcggtcgccaccaccgtgatcacgcccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgacggccgccgtgctcctgctgatcacccactacgcgatcatcggccccggcctccaggccaaggccacccgcgaggcccagaagcggaccgccgcggggatcatgaagaacccgacggtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgaccctggcgacgggccccatcaccaccctctgggagggctcccccgggaagttctggaacaccacgatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggccaaggaggggctgaagcggggcgagatcacccaccacgccgtgagccgcggctccgccaagctgcagtggttcgtggagcggaacatggtcatcccggaggggcgcgtgatcgacctcggctgcgggcgcggcgggtggagctactactgcgccggcctgaagaaggtgaccgaggtccggggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccgcaccatccgggtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggcgagcgtgaacatggtctcccgcctcctgctgaaccggttcaccatgacgcaccgccggccgaccatcgagaaggacgtggacctcggcgccggcacccgccacgtgaacgccgagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcgtccagcatgatcaacggcgtggtcaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatggagatcaccgccgagtggctctggcgcacgctgggccgcaacaagaagccccggctgtgcacccgcgaggagttcaccaagaaggtgcggaccaacgccgcgatgggggccgtcttcacggaggagaaccagtgggactccgccaaggccgccgtggaggacgaggacttctggaagctcgtggaccgcgagcgggagctgcacaagctgggcaagtgcgggagctgcgtctacaacatgatgggcaagcgcgagaagaagctcggggagttcggcaaggcgaagggctcccgggccatctggtacatgtggctgggggcccgctacctggagttcgaggccctcggcttcctgaacgaggaccactggttcagccgggagaactcctacagcggggtggagggcgaggggctgcacaagctcggctacatcctgcgcgacatctccaagatccccggcggggccatgtacgcggacgacaccgccggctgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccgggaccgtgatggacatcatcagccgcaaggaccagcggggctccggccaggtcgggacgtacggcctgaacaccttcaccaacatggaggcccagctcatccgccagatggagggggagggcgtgctgagcaaggcggacctggagaacccccacctcccggagaagaagatcacccagtggctggagacgaagggggtggagcggctgaagcgcatggccatctccggcgacgactgcgtcgtgaagcccatcgacgaccggttcgccaacgccctcctggccctgaacgacatgggcaaggtgcgcaaggacatcccccagtggcagcccagcaaggggtggcacgactggcagcaggtcccgttctgctcccaccacttccacgagctcatcatgaaggacggccggaagctggtggtgccctgccgcccccaggacgagctgatcgggcgcgcgcggatcagccagggcgccgggtggtccctccgcgagaccgcctgcctgggcaaggcctacgcgcagatgtggagcctgatgtacttccaccggcgcgacctccggctggcctccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcggcaagcgcgaggaccagtggtgcgggagcctgatcggcctgacctcccgggcgacgtgggcccagaacatcccgaccgccatccagcaggtccgcagcctcatcgggaacgaggagttcctggactacatgccctccatgaagcggttccgcaaggaggaggagagcgagggcgccatctggtga

SEQ ID NO: 9898 - RNA, 9873 nt, synthetic construct
  misc_feature 1..9873: note = derived and/or modified CDS sequence (opt1) from DENV-3__GU131870__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtaccggggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcgggatcctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcggctcgccaccgccatcgccggcgcgtgggagaacggggtgtgcggcatccgcagcacgacccggatggagaacctgctgtggaagcagatcgccaacgagctcaaccacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgcgatcctgttcgaggaggtgatgcgggggaagttcggcaagaagcacatgatcgccggggtcttcttcaccttcgtgctgctcctgtccggccagatcacctggcgcgacatgacccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtcggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtgagcctgctgccggtctgccagtccagctccatgcgcaagaccgactggctccccatggccgtggccgccatgggcgtgccgcccctcccgctgttcatcttcagcctcaaggacacgctgaagcggcgctcctggcccctgaacgagggggtgatggccgtgggcctcgtcagcatcctggcgtccagcctgctccggaacgacgtgcccatggccggccccctggtggccgggggcctgctcatcgcctgctacgtcatcaccgggacctccgccgacctgatcgtggagaaggcggccgacatcacctgggaggaggaggccgagcagacgggcgtgagccacaacctgatgatcaccgtcgacgacgacgggaccatgcgcatcaaggacgacgagaccgagaacatcctcaccgtgctgctgaagacggccctcctgatcgtgtccggcgtcttcccgtacagcatccccgccaccctgctcgtgtggcacacctggcagaagcagacccagcggtccggcgtgctgtgggacgtccccagcccgcccgagacgcagaaggcggagctggaggagggggtgtaccgcatcaagcagcagggcatcttcgggaagacccaggtgggcgtcggggtgcagaaggagggcgtgttccacaccatgtggcacgtcacccggggcgccgtgctcacgtacaacgggaagcgcctggagcccaactgggcctccgtgaagaaggacctgatcagctacggcgggggctggcggctctccgcccagtggcagaagggggaggaggtccaggtgatcgcggtggagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcatccgggaggccatcaagcgccggctccgcacgctgatcctggcccccacccgggtggtcgccgccgagatggaggaggcgctcaaggggctgcccatccgctaccagaccaccgccacgaagtccgagcacaccggccgggagatcgtggacctgatgtgccacgccaccttcaccatgcgcctcctgagccccgtgcgggtcccgaactacaacctgatcatcatggacgaggcccacttcacggaccccgcctccatcgcggcccgcgggtacatcagcacccgcgtgggcatgggcgaggccgccgcgatcttcatgaccgccacgccgcccgggacggccgacgccttcccgcagtccaacgcccccatccaggacgaggagcgggacatccccgagcgcagctggaactccggcaacgagtggatcaccgacttcgcggggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaaggccgaccgggtgatcgacccgcgccggtgcctcaagcccgtgatcctgacggacggccccgagcgcgtcatcctggcggggcccatgccggtgaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtcgagctgatgcgccgcggggacctccccgtgtggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccgctggctggacgcccggacctactccgacccgctggccctcaaggagttcaaggacttcgcggccggccgcaagagcatcgccctggacctggtgacggagatcgggcgggtcccctcccacctcgcccaccgcacccggaacgccctggacaacctggtgatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgcgagcgccatcgtgctggagttcttcatgatggtgctcctgatccccgagcccgagaagcagcgcacgccccaggacaaccagctggcctacgtcgtgatcgggatcctcacgctggccgccatcatcgcggccaacgagatgggcctgctcgagaccaccaagcgggacctgggcatgtccaaggagccgggggtggtcagccccacctcctacctggacgtggacctccaccccgccagcgcctggacgctgtacgcggtggccaccaccgtcatcacccccatgctgcgccacacgatcgagaactccaccgccaacgtgagcctcgccgccatcgcgaaccaggccgtggtcctgatgggcctggacaaggggtggccgatctccaagatggacctcggcgtgcccctgctggccctcgggtgctacagccaggtgaaccccctgaccctgaccgccgccgtcctcctgctgatcacgcactacgcgatcatcggccccggcctccaggccaaggccacccgggaggcccagaagcgcaccgccgcggggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcggaccagctgggccctctgcgaggccctgaccctggcgaccggccccatcacgaccctctgggagggctcccccgggaagttctggaacaccaccatcgccgtcagcatggccaacatcttccgcggctcctacctggccggggccggcctggcgttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcgcggctacaccaagggcgggcccgggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgtcccgcaacagcacgcacgagatgtactggatctccaacggcaccgggaacatcgtcgcgagcgtgaacatggtgtcccggctcctgctgaaccgcttcaccatgacccaccggcgcccgacgatcgagaaggacgtcgacctcggcgccggcacccggcacgtgaacgccgagcccgagacccccaacatggacgtgatcggggagcgcatcaagcggatcaaggaggagcacaacagcacctggcactacgacgacgagaacccgtacaagacgtgggcctaccacggctcctacgaggtcaaggccaccgggagcgcgtccagcatgatcaacggcgtggtgaagctgctgaccaagccctgggacgtcgtgcccatggtcacccagatggccatgacggacaccacccccttcgggcagcagcgcgtgttcaaggagaaggtggacacccggacgccgcgcagcatgcccggcacccggcgcgtcatgggcatcaccgccgagtggctctggcggaccctggggcgcaacaagaagccccgcctgtgcacgcgggaggagttcaccaagaaggtgcgcaccaacgccgcgatgggcgccgtgttcaccgaggagaaccagtgggactccgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtggtgaaggtccagcgccccacccccaccggcaccgtgatggacatcatcagccggaaggaccagcgcggctccggccaggtgggcacctacgggctgaacacgttcaccaacatggaggcccagctcatccggcagatggagggcgagggggtcctgagcaaggcggacctggagaacccccacctcccggagaagaagatcacccagtggctggagaccaagggcgtggagcgcctgaagcggatggccatctccggcgacgactgcgtggtcaagcccatcgacgaccgcttcgccaacgccctcgtggccctgaacgacatggggaaggtgcggaaggacatcccccagtggcagcccagcaagggctggcacgactggcagcaggtcccgttctgctcccaccacttccacgagctgatcatgaaggacgggcgcaagctcgtggtgccctgccggccccaggacgagctgatcggccgcgcgcgcatcagccagggggccggctggtccctgcgggagacggcctgcctcggcaaggcctacgcgcagatgtggagcctgatgtacttccaccgccgggacctgcgcctcgcctccaacgccatctgcagcgccgtccccgtgcactgggtgccgacctcccggaccacctggagcatccacgcccaccaccagtggatgacgaccgaggacatgctgaccgtctggaaccgcgtgtggatcgaggacaacccctggatggaggacaagacccccgtgacgacctgggagaacgtcccctacctggggaagcgggaggaccagtggtgcggcagcctcatcgggctgacctcccgcgcgacctgggcccagaacatcccgacggccatccagcaggtccggagcctgatcggcaacgaggagttcctcgactacatgccctccatgaagcgcttccggaaggaggaggagagcgagggggccatctggtga

SEQ ID NO: 9899 - RNA, 9873 nt, synthetic construct
  misc_feature 1..9873: note = derived and/or modified CDS sequence (opt1) from DENV-3__GU131871__SS-prME
  source 1..9873: mol_type = other RNA
accagcctctgcctcgtgatgatcctgcccgccgccctggcgttccacctcaccagccgggacggcgagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtcacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccaccggcgccaccacggagacccccacctggaaccggaaggagctcctggtcaccttcaagaacgcccacgccaagaagcaggaggtggtggtcctggggagccaggagggcgcgatgcacacggccctcaccggggccaccgagatccagaactccggcgggaccagcatcttcgccggccacctgaagtgccgcctgaagatggacaagctcgagctgaagggcatgtcctacgccatgtgcacgaacaccttcgtgctgaagaaggaggtgagcgagacccagcacgggaccatcctcatcaaggtcgagtaccggggcgaggacgcgccgtgcaagatccccttctccacggaggacgggcagggcaaggcccacaacggccgcctgatcaccgccaaccccgtggtgaccaagaaggaggagcccgtcaacatcgaggccgagccgcccttcggggagagcaacatcgtgatcggcatcggggacaacgcgctgaagatcaactggtacaagaagggcagctccatcgggaagatgttcgaggccaccgcccggggcgcccgccgcatggccatcctgggcgacacggcgtgggacttcgggagcgtgggcggggtcctcaactccctgggcaagatggtgcaccagatcttcgggagcgcctacaccgccctgttctccggcgtgagctgggtcatgaagatcggcatcgggatcctcctgacctggatcggcctgaactccaagaacaccagcatgtccttcagctgcatcgccatcgggatcatcacgctctacctgggcgccgtggtgcaggcggacatggggtgcgtcatcaactggaagggcaaggagctgaagtgcggctccgggatcttcgtgaccaacgaggtgcacacctggaccgagcagtacaagttccaggccgacagccccaagcggctcgccacggccatcgccggcgcgtgggagaacggggtctgcggcatccgctccaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtacagctggaagacctgggggaaggccaagatcgtgaccgccgagacgcagaactccagcttcatcatcgacggccccaacacccccgagtgcccctccgcgagccgggcctggaacgtctgggaggtggaggactacgggttcggcgtgttcaccaccaacatctggctcaagctgcgcgaggtctacacccagctgtgcgaccaccggctcatgtccgccgccgtgaaggacgagcgcgccgtgcacgcggacatgggctactggatcgagagccagaagaacgggagctggaagctggagaaggcctccctgatcgaggtcaagacgtgcacctggcccaagtcccacaccctctggtccaacggcgtgctggagagcgacatgatcatccccaagtccctggccgggcccatcagccagcacaaccaccggccgggctaccacacccagacggccgggccctggcacctcggcaagctggagctggacttcaactactgcgagggcaccaccgtggtcatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcagcgagaaggaggagaacatggtgaagtccctggtcagcgccggctccgggaaggtggacaacttcaccatgggcgtgctgtgcctcgcgatcctgttcgaggaggtcatgcgggggaagttcggcaagaagcacatgatcgccggggtgttcttcaccttcgtgctgctcctgagcggccagatcacctggcgcgacatgacgcacaccctgatcatgatcggctccaacgccagcgaccggatggggatgggcgtcacctacctcgccctgatcgccaccttcaagatccagcccttcctggcgctcgggttcttcctgcgcaagctgacgtcccgggagaacctcctgctgggcgtgggcctcgccatggccaccaccctgcagctgcccgaggacatcgagcagatggccaacgggatcgcgctcggcctgatggccctgaagctcatcacccagttcgagacgtaccagctgtggaccgccctgatcagcctgacctgcagcaacaccatgttcacgctgaccgtggcctggcgcaccgccaccctgatcctcgcgggggtctccctgctgccggtgtgccagagctccagcatgcgcaagacggactggctccccatggccgtcgccgccatgggcgtgccgcccctcccgctgttcatcttctccctcaaggacaccctgaagcggcgcagctggcccctgaacgagggggtgatggccgtcggcctcgtgtccatcctggcgagctccctgctccggaacgacgtgcccatggccggccccctggtcgccgggggcctgctcatcgcctgctacgtgatcaccgggaccagcgccgacctgacggtggagaaggcggccgacatcacctgggaggaggaggccgagcagaccggcgtctcccacaacctgatgatcaccgtggacgacgacgggaccatgcgcatcaaggacgacgagacggagaacatcctcaccgtgctgctgaagaccgccctcctgatcgtcagcggcgtgttcccgtactccatccccgccaccctgctcgtgtggcacacgtggcagaagcagacccagcggagcggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacacgatgtggcacgtgacccggggcgccgtgctcacctacaacgggaagcgcctggagcccaactgggccagcgtcaagaaggacctgatctcctacggcgggggctggcggctcagcgcccagtggcagaagggggaggaggtccaggtgatcgcggtcgagcccggcaagaaccccaagaacttccagaccacgcccggcaccttccagaccaccacgggggagatcggcgccatcgccctggacttcaagcccgggacctccggcagccccatcatcaaccgcgagggcaaggtggtggggctgtacggcaacggggtcgtgaccaagaacggcgggtacgtgagcggcatcgcccagaccaacgccgagccggacggccccacgcccgagctggaggaggagatgttcaagaagcggaacctcaccatcatggacctgcaccccgggtccggcaagacccgcaagtacctgccggcgatcatccgggaggccatcaagcgccggctccgcaccctgatcctggcccccacgcgggtcgtggccgccgagatggaggaggcgctcaaggggctgcccatccgctaccagaccaccgccaccaagagcgagcacacgggccgggagatcgtggacctgatgtgccacgccaccttcaccatgcgcctcctgtcccccgtccgggtgccgaactacaacctgatcatcatggacgaggcccacttcaccgaccccgccagcatcgcggcccgcgggtacatctccacgcgcgtgggcatgggcgaggccgccgcgatcttcatgaccgccacgccgcccgggaccgccgacgccttcccgcagagcaacgcccccatccaggacgaggagcgggacatccccgagcgctcctggaacagcggcaacgagtggatcacggacttcgcggggaagaccgtctggttcgtgccctccatcaaggccggcaacgacatcgccaactgcctccggaagaacgggaagaaggtgatccagctgagccgcaagaccttcgacaccgagtaccagaagacgaagctgaacgactgggacttcgtcgtgaccaccgacatctccgagatgggcgccaacttcaaggccgaccgggtgatcgacccgcgccggtgcctcaagcccgtcatcctgaccgacggccccgagcgcgtgatcctggcggggcccatgccggtgaccgccgccagcgccgcccagcggcgcggccgggtcgggcgcaacccccagaaggagaacgaccagtacatcttcacgggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagagccggaagaccttcgtggagctgatgcgccgcggggacctccccgtgtggctggcccacaaggtcgcctccgagggcatcaagtacacggaccgcaagtggtgcttcgacgggcagcggaacaaccagatcctggaggagaacatggacgtggagatctggaccaaggagggcgagaagaagaagctccgcccccgctggctggacgcccggacctacagcgacccgctggccctcaaggagttcaaggacttcgcggccggccgcaagtccatcgccctggacctggtcaccgagatcgggcgggtgcccagccacctcgcccaccgcacgcggaacgccctggacaacctggtgatgctccacacctccgagcacggcgggcgcgcgtaccggcacgccgtcgaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcgtccgccatcgtgctggagttcttcatgatggtcctcctgatccccgagcccgagaagcagcgcacgccccaggacaaccagctggcctacgtggtgatcgggatcctcaccctggccgccatcatcgcggccaacgagatgggcctgctcgagacgaccaagcgggacctgggcatgagcaaggagccgggggtcgtgtcccccaccagctacctggacgtggacctccaccccgcctccgcctggaccctgtacgcggtcgccacgaccgtgatcacccccatgctgcgccacaccatcgagaacagcacggccaacgtgtccctcgccgccatcgcgaaccaggccgtcgtgctgatgggcctggacaaggggtggccgatcagcaagatggacctcggcgtgcccctgctggccctcgggtgctactcccaggtcaaccccctgaccctgaccgccgccgtgctcctgctgatcacccactacgcgatcatcggccccggcctccaggccaaggccacgcgggaggcccagaagcgcaccgccgcggggatcatgaagaacccgaccgtggacggcatcatgaccatcgacctggaccccgtcatctacgacagcaagttcgagaagcagctgggccaggtgatgctcctggtgctgtgcgccgtccagctcctgctgatgcggacgtcctgggccctctgcgaggccctgaccctggcgaccggccccatcaccacgctctgggagggcagccccgggaagttctggaacaccaccatcgccgtgtccatggccaacatcttccgcggcagctacctggccggggccggcctggcgttctccatcatgaagtccgtggggaccggcaagcggggcaccgggtcccagggcgagacgctcggggagaagtggaagcgcaagctgaaccagctgagccggaaggagttcgacctctacaagaagtccggcatcaccgaggtcgaccgcaccgaggccaaggaggggctgaagcggggcgagatcacccaccacgccgtgtcccgcggcagcgccaagctgcagtggttcgtggagcggaacatggtcatcccggaggggcgcgtgatcgacctcggctgcgggcgcggcgggtggtcctactactgcgccggcctgaagaaggtgacggaggtccggggctacaccaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccacggtggaggagtcccgcaccatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcacggggaacatcgtggcgtccgtgaacatggtcagccgcctcctgctgaaccggttcaccatgacccaccgccggccgaccatcgagaaggacgtggacctcggcgccggcacgcgccacgtgaacgccgagcccgagacccccaacatggacgtcatcggggagcggatcaagcgcatcaaggaggagcacaactccacctggcactacgacgacgagaacccgtacaagacctgggcctaccacggcagctacgaggtgaaggccacggggtccgcgagctccatgatcaacggcgtggtcaagctgctgaccaagccctgggacgtggtccccatggtgacccagatggccatgaccgacacgacccccttcgggcagcagcgggtgttcaaggagaaggtcgacacccgcaccccgcggagcatgcccggcacgcgccgggtgatggagatcaccgccgagtggctctggcgcaccctgggccgcaacaagaagccccggctgtgcacccgcgaggagttcacgaagaaggtgcggaccaacgccgcgatgggggccgtcttcaccgaggagaaccagtgggacagcgccaaggccgccgtggaggacgaggacttctggaagctcgtggaccgcgagcgggagctgcacaagctgggcaagtgcgggtcctgcgtctacaacatgatgggcaagcgcgagaagaagctcggggagttcggcaaggcgaagggcagccgggccatctggtacatgtggctgggggcccgctacctggagttcgaggccctcggcttcctgaacgaggaccactggttctcccgggagaacagctactccggggtggagggcgaggggctgcacaagctcggctacatcctgcgcgacatcagcaagatccccggcggggccatgtacgcggacgacaccgccggctgggacacgcggatcaccgaggacgacctgcacaacgaggagaagatcacccagcagatggacccggagcaccgccagctcgccaacgccatcttcaagctgacctaccagaacaaggtggtcaaggtgcagcggcccacccccacggggaccgtgatggacatcatctcccgcaaggaccagcggggcagcggccaggtcgggacctacggcctgaacaccttcacgaacatggaggcccagctcatccgccagatggagggggagggcgtgctgtccaaggcggacctggagaacccccacctcccggagaagaagatcacccagtggctggagaccaagggggtggagcggctgaagcgcatggccatcagcggcgacgactgcgtcgtgaagcccatcgacgaccggttcgccaacgccctcctggccctgaacgacatgggcaaggtgcgcaaggacatcccccagtggcagccctccaaggggtggcacgactggcagcaggtcccgttctgcagccaccacttccacgagctcatcatgaaggacggccggaagctggtggtgccctgccgcccccaggacgagctgatcgggcgcgcgcggatctcccagggcgccgggtggagcctccgcgagaccgcctgcctgggcaaggcctacgcgcagatgtggtccctgatgtacttccaccggcgcgacctccggctggccagcaacgccatctgctccgccgtccccgtgcactgggtgccgacgagccgcaccacctggtccatccacgcccaccaccagtggatgaccacggaggacatgctgaccgtctggaaccgggtgtggatcgaggacaacccctggatggaggacaagacccccgtgaccacgtgggagaacgtcccctacctcggcaagcgcgaggaccagtggtgcgggagcctgatcggcctgaccagccgggcgacctgggcccagaacatcccgaccgccatccagcaggtccgctccctcatcgggaacgaggagttcctggactacatgcccagcatgaagcggttccgcaaggaggaggagtccgagggcgccatctggtga

SEQ ID NO: 9900 - RNA, 9873 nt, synthetic construct
  misc_feature 1..9873: note = derived and/or modified CDS sequence (opt1) from DENV-3__GU131872__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtcgagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatggtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccacccccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcatccgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgacggccacgccgcccgggaccgccgacgccttcccgcagtccaacgcccccatccaggacgaggagcgggacatccccgagcgcagctggaactccggcaacgagtggatcaccgacttcgcggggaagacggtctggttcgtgcccagcatcaaggccggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccgctggctggacgcccggacctactccgacccgctggccctcaaggagttcaaggacttcgcggccggccgcaagagcatcgccctggacctggtcaccgagatcgggcgggtgccctcccacctcgcccaccgcacccggaacgccctggacaacctggtgatgctccacacgagcgagcacggcgggcgcgcgtaccggcacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccctggccgccatcatcgcggccaacgagatgggcctgctcgagaccacgaagcgggacctgggcatgtccaaggagccgggggtcgtgagccccacctcctacctggacgtggacctccaccccgccagcgcctggaccctgtacgcggtcgccaccacggtgatcacccccatgctgcgccacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgggaggcccagaagcgcacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcggaccagctgggccctctgcgaggccctgacgctggcgaccggccccatcaccaccctctgggagggctcccccgggaagttctggaacacgaccatcgccgtgagcatggccaacatcttccgcggctcctacctggccggggccggcctggcgttcagcatcatgaagtccgtggggaccggcaagcggggcaccgggagccagggcgagaccctcggggagaagtggaagaagaagctgaaccagctgagccgcaaggagttcgacctctacaagaagtccggcatcacggaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcacgatgacccaccggcgcccgaccatcgagaaggacgtggacctcggcgccggcacccggcacgtgaacgccgagcccgagacgcccaacatggacgtcatcggggagcgcatcaagcggatcaaggaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgcgtgttcaaggagaaggtcgacacccggaccccgcgcagcatgcccggcacccggcgcgtgatggagatcacggccgagtggctctggcggaccctgggccgcaacaagaagccccgcctgtgcacccgggaggagttcaccaagaaggtgcgcacgaacgccgcgatgggggccgtcttcaccgaggagaaccagtgggactccgccaaggccgccgtggaggacgaggacttctggaagctcgtggaccgggagcgcgagctgcacaagctgggcaagtgcgggagctgcgtctacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgcggacgacaccgccggctgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccgggacggtgatggacatcatcagccggaaggaccagcgcggctccggccaggtcgggacctacggcctgaacaccttcaccaacatggaggcccagctcatccggcagatggagggggagggcgtgctgagcaaggcggacctggagaacccccacctcccggagaagaagatcacgcagtggctggagaccaagggggtggagcgcctgaagcggatggccatctccggcgacgactgcgtcgtgaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtggtgccctgccggccccaggacgagctgatcgggcgcgcgcgcatcagccagggcgccgggtggtccctccgggagaccgcctgcctgggcaaggcctacgcgcagatgtggagcctgatgtacttccaccgccgggacctccgcctggcctccaacgccatctgcagcgccgtccccgtgcactgggtgccgacctcccggacgacctggagcatccacgcccaccaccagtggatgaccaccgaggacatgctgacggtctggaaccgcgtgtggatcgaggacaacccctggatggaggacaagacccccgtgaccacctgggagaacgtcccctacctcggcaagcgggaggaccagtggtgcgggagcctgatcggcctgacgtcccgcgcgacctgggcccagaacatcccgaccgccatccagcaggtccggagcctcatcgggaacgaggagttcctggactacatgccctccatgaagcgcttccggaaggaggaggagagcgagggcgccatctggtga

SEQ ID NO: 9901 - RNA, 9873 nt, synthetic construct
  misc_feature 1..9873: note = derived and/or modified CDS sequence (opt1) from DENV-3__GU131873__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcaccccgggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagctcatcgagggcaaggtcgtgcagtacgagaacctgaagtacaccgtggtcatcacggtgcacaccggggaccagcaccaggtcggcaacgagacccaggggatcaccgccgagatcacgccccaggccagcaccaccgaggcgatcctgcccgagtacggcaccctcgggctggagtgcagcccccggaccggcctggacttcaacgagatgatcctcctgacgatgaagaacaaggcctggatggtgcaccgccagtggttcttcgacctgccgctcccctggaccagcggcgccaccaccgagacgcccacctggaaccggaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccgcctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccctgcaagatcccgttcagcaccgaggacgggcagggcaaggcccacaacggccggctgatcacggccaaccccgtcgtgaccaagaaggaggagcccgtgaacatcgaggccgagcccccgttcggggagagcaacatcgtcatcggcatcggggacaacgcgctgaagatcaactggtacaagaagggctccagcatcgggaagatgttcgaggccaccgcccgcggcgcccggcgcatggccatcctcggcgacaccgcgtgggacttcgggtccgtgggcggggtgctgaacagcctgggcaagatggtccaccagatcttcgggtccgcctacacggccctcttcagcggcgtgtcctgggtgatgaagatcggcatcggggtcctgctgacctggatcggcctcaacagcaagaacacctccatgagcttctcctgcatcgccatcgggatcatcaccctgtacctgggcgccgtggtgcaggcggacatggggtgcgtcatcaactggaagggcaaggagctcaagtgcggcagcgggatcttcgtgacgaacgaggtgcacacctggaccgagcagtacaagttccaggccgactcccccaagcgcctggccaccgccatcgccggcgcgtgggagaacggggtctgcggcatccggagcacgacccgcatggagaacctgctctggaagcagatcgccaacgagctgaactacatcctgtgggagaacaacatcaagctcaccgtggtggtcggggacatcatcggcgtgctggagcagggcaagcggaccctgacgccccagcccatggagctcaagtactcctggaagacctgggggaaggccaagatcgtgaccgccgagacccagaacagctccttcatcatcgacggcccgaacacgcccgagtgccccagcgcgtcccgcgcctggaacgtctgggaggtggaggactacgggttcggcgtgttcaccaccaacatctggctgaagctgcgggaggtctacacccagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacctgcacgtggcccaagtcccacaccctgtggagcaacggcgtgctggagtccgacatgatcatccccaagtccctcgccgggcccatctcccagcacaaccaccgccccggctaccacacccagaccgccgggccgtggcacctgggcaagctggagctcgacttcaactactgcgagggcacgaccgtggtcatcaccgagaactgcgggacccggggccccagcctgcgcacgaccaccgtgtccgggaagctgatccacgagtggtgctgccggagctgcaccctgccgcccctccgctacatgggcgaggacgggtgctggtacggcatggagatccggccgatctccgagaaggaggagaacatggtcaagagcctggtctccgccggcagcgggaaggtggacaacttcacgatgggcgtgctctgcctggcgatcctgttcgaggaggtcatgcgcgggaagttcggcaagaagcacatgatcgccggggtgttcttcaccttcgtgctcctgctgtccggccagatcacctggcgggacatggcccacaccctcatcatgatcggcagcaacgcctccgaccgcatggggatgggcgtcacgtacctggccctgatcgcgaccttcaagatccagcccttcctcgccctggggttcttcctgcggaagctcaccagccgcgagaacctgctgctcggcgtgggcctggccatggccaccacgctgcagctccccgaggacatcgagcagatggcgaacgggatcgccctgggcctgatggccctcaagctgatcacccagttcgagacctaccagctgtggaccgccctcatcagcctgacgtgctccaacaccatgttcaccctgaccgtggcctggcggacggcgaccctcatcctggccggggtcagcctgctccccgtgtgccagtccagctccatgcgcaagaccgactggctgccgatggccgtcgccgccatgggcgtgccgcccctgcccctcttcatcttcagcctgaaggacaccctgaagcgccggtcctggccgctcaacgagggggtgatggcggtcggcctggtgagcatcctggcctccagcctcctgcgcaacgacgtgcccatggccggccccctggtcgccgggggcctcctgatcgcctgctacgtgatcacggggacctccgcggacctgaccgtggagaaggccgccgacatcacctgggaggaggaggccgagcagacgggcgtcagccacaacctcatgatcaccgtggacgacgacgggaccatgcggatcaaggacgacgagaccgagaacatcctgaccgtgctgctcaagacggccctgctgatcgtctccggcgtgttcccctacagcatcccggcgaccctcctggtgtggcacacctggcagaagcagacccagcgctccggcgtcctgtgggacgtgccctccccgcccgagacgcagaaggccgagctcgaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctggagccgaactgggcctccgtcaagaaggacctcatcagctacggcgggggctggcgcctgtccgcgcagtggcagaagggggaggaggtccaggtgatcgccgtcgagcccggcaagaaccccaagaacttccagaccatgcccggcaccttccagaccacgaccggggagatcggcgccatcgccctggacttcaagccggggaccagcggcagccccatcatcaaccgggagggcaaggtggtggggctgtacggcaacggggtcgtgaccaagaacggcgggtacgtgtccggcatcgcccagacgaacgcggagcccgacggcccgacccccgagctcgaggaggagatgttcaagaagcgcaacctgaccatcatggacctgcaccccgggagcggcaagacccggaagtacctccccgccatcgtccgcgaggccatcaagcggcgcctgcggacgctgatcctcgccccgacccgcgtggtggccgcggagatggaggaggccctgaaggggctgcccatccggtaccagaccaccgccacgaagtccgagcacaccggccgcgagatcgtcgacctcatgtgccacgccaccttcaccatgcggctgctgagccccgtgcgcgtgcccaactacaacctcatcatcatggacgaggcccacttcacggacccggcgtccatcgccgcccgggggtacatcagcacccgcgtcggcatgggcgaggccgcggccatcttcatgaccgccacgccgcccgggacggccgacgccttcccccagtccaacgcgccgatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctgtcccggaagaccttcgacacggagtaccagaagaccaagctcaacgactgggacttcgtggtgaccaccgacatcagcgagatgggcgccaacttcaaggcggaccgcgtcatcgacccccggcgctgcctgaagccggtgatcctgacggacggccccgagcgggtgatcctcgccgggcccatgcccgtcaccgccgcctccgccgcgcagcgccggggccgcgtggggcggaacccgcagaaggagaacgaccagtacatcttcaccggccagcccctgaacaacgacgaggaccacgcccactggaccgaggccaagatgctgctcgacaacgtgaacacccccgaggggatcatccccgccctgttcgagccggagcgcgagaagtccgcggccatcgacggcgagtaccggctgaagggcgagtcccgcaagacgttcgtcgagctcatgcggcgcggggacctgcccgtgtggctggcccacaaggtcgccagcgagggcatcaagtacaccgaccggaagtggtgcttcgacgggcagcgcaacaaccagatcctcgaggagaacatggacgtggagatctggaccaaggagggcgagaagaagaagctgcggccccgctggctggacgcccgcacctactccgaccccctcgcgctgaaggagttcaaggacttcgccgccggccgcaagagcatcgccctggacctcgtgacggagatcgggcgcgtcccgtcccacctggcccaccggacccgcaacgcgctggacaacctcgtgatgctgcacaccagcgagcacggcgggcgggcctaccgccacgccgtggaggagctgcccgagaccatggagacgctcctgctgctcggcctgatgatcctgctcaccgggggcgccatgctgttcatcatcagcggcaaggggatcggcaagacctccatcgggctgatctgcgtcatcgccagctccggcatgctctggatggcggagatccccctgcagtggatcgccagcgccatcgtgctggagttcttcatgatggtgctcctgatcccggagcccgagaagcagcggacgccccaggacaaccagctggcctacgtcgtgatcgggatcctcacgctggccgcgatcatcgccgccaacgagatgggcctgctcgagaccaccaagcgcgacctgggcatgtccaaggagcccggggtggtcagcccgacctcctacctggacgtggacctccaccccgccagcgcgtggacgctgtacgccgtggccaccaccgtcatcacccccatgctgcggcacacgatcgagaactccaccgccaacgtgagcctcgccgcgatcgccaaccaggccgtggtcctgatgggcctggacaaggggtggcccatctccaagatggacctcggcgtgccgctgctggccctcgggtgctacagccaggtgaaccccctgaccctgaccgccgcggtcctcctgctgatcacgcactacgccatcatcggccccggcctccaggccaaggccacccgcgaggcccagaagcggaccgcggccgggatcatgaagaaccccaccgtggacggcatcatgacgatcgacctggacccggtgatctacgactccaagttcgagaagcagctggggcaggtcatgctcctggtgctgtgcgccgtgcagctcctgctgatgcgcaccagctgggccctctgcgaggcgctgaccctggccaccggccccatcacgaccctctgggagggctcccccgggaagttctggaacaccaccatcgccgtcagcatggccaacatcttccggggctcctacctggccggggcgggcctggccttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagatcacgcaccacgccgtcagccgcggctccgccaagctgcagtggttcgtggagcggaacatggtgatccccgaggggcgcgtcatcgacctcggctgcgggcggggcgggtggagctactactgcgcgggcctgaagaaggtgaccgaggtgcgcggctacaccaagggcgggccggggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccgcaccatccgggtgctgaagatggtggagccctggctcaagaacaaccagttctgcatcaaggtcctgaacccctacatgcccaccgtgatcgagcacctggagcgcctccagcggaagcacggcgggatgctggtgcgcaaccccctgtcccggaacagcacgcacgagatgtactggatctccaacggcaccgggaacatcgtcgccagcgtgaacatggtgtcccgcctcctgctgaaccggttcaccatgacccaccgccggcccacgatcgagaaggacgtcgacctcggcgccggcacccgccacgtgaacgccgagccggagacccccaacatggacgtgatcggggagcggatcaagcgcatcaaggaggagcacaacagcacctggcactacgacgacgagaacccctacaagacgtgggcctaccacggctcctacgaggtcaaggcgaccgggagcgcctccagcatgatcaacggcgtggtcaagctgctgaccaagccgtgggacgtggtgcccatggtcacccagatggccatgacggacaccacccccttcgggcagcagcgggtgttcaaggagaaggtggacacccgcacgccccggagcatgccgggcacccgccgggtcatgggcatcaccgccgagtggctctggcgcaccctggggcggaacaagaagccccgcctgtgcacgcgcgaggagttcaccaagaaggtgcggaccaacgcggccatgggcgccgtgttcaccgaggagaaccagtgggactccgccaaggccgcggtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgcgatgtacgccgacgacacggccgggtgggacacccggatcaccgaggacgacctgcacaacgaggagaagatcacccagcagatggaccccgagcaccgccagctcgccaacgccatcttcaagctgacgtaccagaacaaggtggtgaaggtccagcggccgacccccaccggcaccgtgatggacatcatcagccgcaaggaccagcggggctccggccaggtgggcacctacgggctgaacacgttcaccaacatggaggcgcagctcatccgccagatggagggcgagggggtcctgagcaaggccgacctggagaacccccacctccccgagaagaagatcacccagtggctggagaccaagggcgtggagcggctgaagcgcatggccatctccggcgacgactgcgtggtcaagccgatcgacgaccggttcgccaacgccctcctggcgctgaacgacatggggaaggtgcgcaaggacatcccccagtggcagcccagcaagggctggcacgactggcagcaggtccccttctgctcccaccacttccacgagctcatcatgaaggacgggcggaagctggtcgtgccgtgccgcccccaggacgagctgatcggccgggcccgcatcagccagggggccggctggtccctccgcgagacggcctgcctgggcaaggcgtacgcccagatgtggagcctgatgtacttccaccggcgcgacctccggctggcctccaacgccatctgcagcgccgtgcccgtccactgggtgcccacctcccgcaccacctggagcatccacgcgcaccaccagtggatgacgaccgaggacatgctgaccgtgtggaaccgggtctggatcgaggacaacccgtggatggaggacaagacccccgtgacgacctgggagaacgtgccctacctcgggaagcgcgaggaccagtggtgcggcagcctgatcgggctgacctcccgggccacctgggcccagaacatccccacggccatccagcaggtccgcagcctcatcggcaacgaggagttcctggactacatgccgtccatgaagcggttccgcaaggaggaggagagcgagggggccatctggtga

SEQ ID NO: 9902 - RNA, 9873 nt, synthetic construct
  misc_feature 1..9873: note = derived and/or modified CDS sequence (opt1) from DENV-3__GU131874__SS-prME
  source 1..9873: mol_type = other RNA
accagcctgtgcctgatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcaccccgggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgcccgaggagcaggaccagaactacgtctgcaagcacacctacgtggaccgcgggtggggcaacgggtgcggcctcttcgggaagggctccctggtgacctgcgccaagttccagtgcctggagctcatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctgcccgagtacggcaccctcgggctggagtgcagcccccggaccggcctggacttcaacgagatgatcctcctgacgatgaagaacaaggcctggatggtgcaccgccagtggttcttcgacctgccgctcccctggaccagcggcgccaccaccgagacgcccacctggaaccggaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccgcctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccctgcaagatcccgttcagcaccgaggacgggcagggcaaggcccacaacggccggctgatcacggccaaccccgtcgtgaccaagaaggaggagcccgtgaacatcgaggccgagcccccgttcggggagagcaacatcgtcatcggcaccggggacaacgcgctgaagatcaactggtacaagaagggctccagcatcgggaagatgttcgaggccaccgcccgcggcgcccggcgcatggccatcctcggcgacacggcgtgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcggacatggggtgcgtcatcaactggaagggcaaggagctcaagtgcggcagcgggatcttcgtgaccaacgaggtgcacacctggaccgagcagtacaagttccaggccgactcccccaagcgcctggccacggccatcgccggcgcgtgggagaacggggtctgcggcatccggagcaccacccgcatggagaacctgctctggaagcagatcgccaacgagctgaactacatcctgtgggagaacaacatcaagctcaccgtggtggtcggggacatcatcggcgtgctggagcagggcaagcggacgctgacgccccagcccatggagctcaagtactcctggaagacctgggggaaggccaagatcgtgaccgccgagacgcagaacagctccttcatcatcgacggcccgaacacccccgagtgccccagcacctcccgcgcgtggaacgtctgggaggtggaggactacgggttcggcgtgttcaccaccaacatctggctgaagctgcgggaggtctacacgcagctctgcgaccaccgcctgatgagcgccgccgtgaaggacgagcgggccgtgcacgccgacatgggctactggatcgagagccagaagaacgggtcctggaagctggagaaggcgagcctcatcgaggtcaagacctgcacctggcccaagtcccacaccctgtggagcaacggcgtgctggagtccgacatgatcatccccaagtccctcgccgggcccatctcccagcacaaccaccgccccggctaccacacgcagaccgccgggccgtggcacctgggcaagctggagctcgacttcaactactgcgagggcaccaccgtggtcatcacggagaactgcgggacccggggccccagcctgcgcaccaccacggtgtccgggaagctgatccacgagtggtgctgccggagctgcaccctgccgcccctccgctacatgggcgaggacgggtgctggtacggcatggagatccggccgatctccgagaaggaggagaacatggtcaagagcctggtctccgccggcagcgggaaggtggacaacttcaccatgggcgtgctctgcctggccatcctgttcgaggaggtcatgcgcgggaagttcggcaagaagcacatgatcgcgggggtgttcttcaccttcgtgctcctgctgtccggccagatcacgtggcgggacatggcccacaccctcatcatgatcggcagcaacgcctccgaccgcatggggatgggcgtcacctacctggccctgatcgccaccttcaagatccagcccttcctcgcgctggggttcttcctgcggaagctcacgagccgcgagaacctgctgctcggcgtgggcctggccatggccaccaccctgcagctccccgaggacatcgagcagatggccaacgggatcgcgctgggcctgatggccctcaagctgatcacccagttcgagacgtaccagctgtggaccgccctcatcagcctgacctgctccaacaccatgttcacgctgaccgtggcctggcggaccgccaccctcatcctggcgggggtcagcctgctccccgtgtgccagtccagctccatgcgcaagacggactggctgccgatggccgtcgccgccatgggcgtgccgcccctgcccctcttcatcttcagcctgaaggacaccctgaagcgccggtcctggccgctcaacgagggggtgatggccgtcggcctggtgagcatcctggcgtccagcctcctgcgcaacgacgtgcccatggccggccccctggtcgccgggggcctcctgatcgcctgctacgtgatcaccgggacctccgccgacctgacggtggagaaggcggccgacatcacctgggaggaggaggccgagcagaccggcgtcagccacaacctcatgatcaccgtggacgacgacgggaccatgcggatcaaggacgacgagacggagaacatcctgaccgtgctgctcaagaccgccctgctgatcgtctccggcgtgttcccctacagcatcccggccaccctcctggtgtggcacacgtggcagaagcagacccagcgctccggcgtcctgtgggacgtgccctccccgcccgagacccagaaggcggagctcgaggagggggtgtaccggatcaagcagcagggcatcttcgggaagacccaggtcggcgtgggggtgcagaaggagggcgtcttccacacgatgtggcacgtgacccgcggcgccgtgctgacctacaacgggaagcggctggagccgaactgggcctccgtcaagaaggacctcatcagctacggcgggggctggcgcctgtccgcccagtggcagaagggggaggaggtccaggtgatcgcggtcgagcccggcaagaaccccaagaacttccagaccatgcccggcacgttccagaccaccaccggggagatcggcgccatcgccctggacttcaagccggggacgagcggcagccccatcatcaaccgggagggcaaggtggtggggctgtacggcaacggggtcgtgaccaagaacggcgggtacgtgtccggcatcgcccagaccaacgccgagcccgacggcccgacccccgagctcgaggaggagatgttcaagaagcgcaacctgacgatcatggacctgcaccccgggagcggcaagacccggaagtacctccccgcgatcgtccgcgaggccatcaagcggcgcctgcggaccctgatcctcgccccgacccgcgtggtggccgccgagatggaggaggcgctgaaggggctgcccatccggtaccagacgaccgccaccaagtccgagcacaccggccgcgagatcgtcgacctcatgtgccacgccacgttcaccatgcggctgctgagccccgtgcgcgtgcccaactacaacctcatcatcatggacgaggcccacttcaccgacccggcctccatcgcggcccgggggtacatcagcacccgcgtcggcatgggcgaggccgccgcgatcttcatgacggccacgccgcccgggaccgccgacgccttcccccagtccaacgccccgatccaggacgaggagcgcgacatccccgagcggagctggaactccggcaacgagtggatcaccgacttcgcggggaagacggtgtggttcgtgcccagcatcaaggccggcaacgacatcgccaactgcctgcgcaagaacgggaagaaggtcatccagctgtcccggaagaccttcgacaccgagtaccagaagaccaagctcaacgactgggacttcgtggtgacgaccgacatcagcgagatgggcgccaacttcaaggccgaccgcgtcatcgacccccggcgctgcctgaagccggtgatcctgaccgacggccccgagcgggtgatcctcgcggggcccatgcccgtcaccgccgcctccgccgcccagcgccggggccgcgtggggcggaacccgcagaaggagaacgaccagtacatcttcaccggccagcccctgaacaacgacgaggaccacgcgcactggacggaggccaagatgctgctcgacaacatcaacacccccgaggggatcatccccgccctgttcgagccggagcgcgagaagtccgccgcgatcgacggcgagtaccggctgaagggcgagtcccgcaagaccttcgtggagctcatgcggcgcggggacctgcccgtctggctggcccacaaggtggccagcgagggcatcaagtacaccgaccggaagtggtgcttcgacgggcagcgcaacaaccagatcctcgaggagaacatggacgtcgagatctggacgaaggagggcgagaagaagaagctgcggccccgctggctggacgcccgcacctactccgaccccctcgccctgaaggagttcaaggacttcgcggccggccgcaagagcatcgccctggacctcgtgaccgagatcgggcgcgtgccgtcccacctggcccaccggacccgcaacgccctggacaacctcgtcatgctgcacacgagcgagcacggcgggcgggcgtaccgccacgccgtggaggagctgcccgagaccatggagaccctcctgctgctcggcctgatgatcctgctcaccgggggcgccatgctgttcctgatcagcggcaaggggatcggcaagacgtccatcgggctcatctgcgtgatcgccagctccggcatgctgtggatggccgagatccccctgcagtggatcgcgagcgccatcgtcctcgagttcttcatgatggtgctgctgatcccggagcccgagaagcagcggacgccccaggacaaccagctcgcctacgtggtcatcgggatcctgaccctggccgccatcatcgcggccaacgagatgggcctcctggagaccacgaagcgcgacctgggcatgtccaaggagcccggggtggtgagcccgacctcctacctcgacgtcgacctgcaccccgccagcgcctggaccctgtacgcggtggccaccacggtgatcacccccatgctccggcacaccatcgagaactccaccgccaacgtcagcctggccgccatcgcgaaccaggccgtggtgctgatgggcctcgacaaggggtggcccatctccaagatggacctgggcgtcccgctgctcgccctggggtgctacagccaggtgaaccccctgacgctcaccgccgccgtgctgctgctcatcacccactacgcgatcatcggccccggcctgcaggccaaggccacccgcgaggcccagaagcggacggccgcggggatcatgaagaaccccaccgtcgacggcatcatgaccatcgacctggacccggtgatctacgactccaagttcgagaagcagctcggccaggtgatgctgctggtcctctgcgccgcccagctgctgctcatgcgcaccagctgggccctgtgcgaggcgctgacgctcgccaccggccccatcaccaccctgtgggagggctcccccgggaagttctggaacacgaccatcgccgtgagcatggccaacatcttccggggctcctacctggccggggcgggcctcgccttcagcatcatgaagtccgtggggaccggcaagcgcggcaccgggagccagggcgagaccctgggggagaagtggaagaagaagctgaaccagctcagccggaaggagttcgacctgtacaagaagtccggcatcacggaggtcgaccgcaccgaggccaaggaggggctgaagcggggcgagatcacccaccacgccgtgagccgcggctccgccaagctccagtggttcgtggagcggaacatggtcatccccgaggggcgcgtgatcgacctgggctgcgggcggggcgggtggagctactactgcgcgggcctgaagaaggtgaccgaggtccgcggctacacgaagggcgggccggggcacgaggagcccgtgcccatgtccacctacggctggaacatcgtgaagctcatgagcgggaaggacgtcttctacctgcccccggagaagtgcgacaccctgctgtgcgacatcggcgagtccagcccctcccccaccgtggaggagagccgcacgatccgggtgctcaagatggtcgagccctggctgaagaacaaccagttctgcatcaaggtgctgaacccgtacatgcccaccgtgatcgagcacctcgagcgcctgcagcggaagcacggcgggatgctggtccgcaaccccctctcccggaacagcacccacgagatgtactggatctccaacggcaccgggaacatcgtggccagcgtgaacatggtctcccgcctgctgctcaaccggttcacgatgacccaccgccggcccaccatcgagaaggacgtggacctgggcgccggcacccgccacgtgaacgccgagccggagacgcccaacatggacgtcatcggggagcggatcaagcgcatcaaggaggagcacaacagcacctggcactacgacgacgagaacccctacaagacctgggcctaccacggctcctacgaggtgaaggcgaccgggagcgcctccagcatgatcaacggcgtggtcaagctgctcacgaagccgtgggacgtggtccccatggtgacccagatggccatgaccgacaccacgcccttcgggcagcagcgggtgttcaaggagaaggtcgacacccgcacgccccggagcatgccgggcacccgccgggtgatgggcatcaccgccgagtggctgtggcgcaccctggggcggaacaagcgcccccgcctctgcacccgggaggagttcaccaagaaggtgcgcacgaacgcggccatgggcgccgtcttcaccgaggagaaccagtgggactccgccaaggccgcggtggaggacgaggacttctggaagctggtggaccgggagcgcgagctgcacaagctcgggaagtgcggcagctgcgtctacaacatgatggggaagcgggagaagaagctgggcgagttcggcaaggccaaggggtcccgcgccatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgcgatgtacgccgacgacaccgccgggtgggacacccgcatcacggaggacgacctccacaacgaggagaagatcacccagcagatggaccccgagcaccggcagctggccaacgccatcttcaagctgacctaccagaacaaggtggtcaaggtgcagcgcccgacccccaccggcacggtgatggacatcatcagccggaaggaccagcgcggctccgggcaggtcggcacctacgggctcaacaccttcaccaacatggaggcgcagctgatccggcagatggagggcgagggggtgctgagcaaggccgacctcgagaacccccacctccccgagaagaagatcgcccagtggctggagacgaagggcgtggagcgcctcaagcggatggccatctccggcgacgactgcgtcgtgaagccgatcgacgaccgcttcgccaacgcgctgctggccctcaacgacatggggaaggtgcggaaggacatcccccagtggcagcccagcaagggctggcacgactggcagcaggtccccttctgctcccaccacttccacgagctgatcatgaaggacgggcgcaagctggtggtgccgtgccggccccaggacgagctcatcggccgcgcccgcatcagccaggggtccggctggagcctgcgggagaccgcctgcctgggcaaggcgtacgcccagatgtggtccctcatgtacttccaccgccgggacctgcgcctggccagcaacgccatctgctccgccgtccccgtgcactgggtgcccaccagccggaccacgtggagcatccacgcgcaccaccagtggatgaccaccgaggacatgctcgccgtctggaaccgcgtgtggatcgaggacaacccgtggatggaggacaagacccccgtgacgacctgggagaacgtcccctacctggggaagcgggaggaccagtggtgcggctccctgatcgggctcaccagccgcgccacctgggcccagaacatccccacggccatccagcaggtccggtccctgatcggcaacgaggagttcctggactacatgccgagcatgaagcgcttccggaaggaggaggagtccgagggggcgatctggtga

SEQ ID NO: 9903 - RNA, 9873 nt, synthetic construct
  misc_feature 1..9873: note = derived and/or modified CDS sequence (opt1) from DENV-3__GU131875__SS-prME
  source 1..9873: mol_type = other RNA
accagcctctgcctcgtgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtcatcttcatcctgctgatgctcgtgacgcccagcatgaccatgcgctgcgtgggggtcggcaaccgggacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtcctgccggaggagcaggaccagaactacgtgtgcaagcacacctacgtggaccgcgggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtgtccgagacccagcacgggaccatcctcatcaaggtcgagtaccggggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcgggatcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatgacccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcatccgggaggccatcaagcgccggctccgcaccctgatcctggcccccacccgggtcgtggccgccgagatggaggaggcgctcaaggggctgcccatccgctaccagaccacggccaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgaccgccacgccgcccgggaccgccgacgccttcccgcagtccaacgcccccatccaggacgaggagcgggacatccccgagcgcagctggaactccggcaacgagtggatcaccgacttcgcggggaagaccgtctggttcgtgcccagcatcaaggccggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggtggaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccgctggctggacgcccggacgtactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggagttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccggaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccgcctgtgcacccgggaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccgcatcagccagggggcgggctggtccctccgggagaccgcctgcctgggcaaggcctacgcccagatgtggagcctgatgtacttccaccgccgggacctccgcctggcgtccaacgccatctgcagcgccgtgcccgtgcactgggtcccgacctcccggaccacgtggagcatccacgcccaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 9904 - RNA, 9873 nt, synthetic construct
  misc_feature 1..9873: note = derived and/or modified CDS sequence (opt1) from DENV-3__GU131877__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtaccggggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcggctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgtcatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatgttcaccctgaccgtcgcctggcgcacggccaccctgatcctcgcgggggtgagcctgctgccggtctgccagtccagctccatgcgcaagaccgactggctccccatggccgtggccgccatgggcgtgccgcccctcccgctgttcatcttcagcctcaaggacaccctgaagcggcgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcatctccggcgtgttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcatccgggaggccatcaagcgccggctccgcacgctgatcctggcccccacccgggtcgtggccgccgagatggaggaggcgctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgcggcccgcgggtacatcagcacccgcgtgggcatgggcgaggccgccgcgatcttcatgaccgccacgccgcccgggacggccgacgccttcccgcagtccaacgcccccatccaggacgaggagcgggacatccccgagcgcagctggaactccggcaacgagtggatcaccgacttcagcgggaagaccgtctggttcgtgccctccatcaaggcgggcaacgacatcgccaactgcctccggaagaacgggaagaaggtgatccagctgagccgcaagaccttcgacacggagtaccagaagaccaagctgaacgactgggacttcgtcgtgaccaccgacatctccgagatgggcgccaacttcaaggccgaccgggtgatcgacccgcgccggtgcctcaagcccgtcatcctgacggacggccccgagcgcgtgatcctggccgggcccatgccggtgaccgcggccagcgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagacgttcgtggagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccgctggctggacgcccggacctacagcgacccgctggccctcaaggagttcaaggacttcgccgcgggccgcaagtccatcgccctggacctggtcacggagatcgggcgggtgcccagccacctcgcccaccgcacccggaacgccctggacaacctggtgatgctccacaccagcgagcacggcgggcgcgcctaccggcacgcggtcgaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcgcacgccccaggacaaccagctggcctacgtggtgatcgggatcctcacgctggccgccatcatcgccgcgaacgagatgggcctgctcgagaccaccaagcgggacctgggcatgagcaaggagccgggggtcgtgtcccccaccagctacctggacgtggacctccaccccgcctccgcctggacgctgtacgccgtcgcgaccaccgtgatcacccccatgctgcgccacacgatcgagaacagcaccgccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgaccctgaccgccgccgtgctcctgctgatcacgcactacgccatcatcggccccggcctccaggcgaaggccacccgggaggcccagaagcgcaccgccgccgggatcatgaagaacccgaccgtggacggcatcatgacgatcgacctggaccccgtcatctacgacagcaagttcgagaagcagctgggccaggtgatgctcctggtgctgtgcgcggtccagctcctgctgatgcggacctcctgggccctctgcgaggccctgaccctggccaccggccccatcacgaccctctgggagggcagccccgggaagttctggaacaccaccatcgcggtgtccatggccaacatcttccgcggcagctacctggccggggccggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtcgaccggaccgaggcgaaggaggggctgaagcgcggcgagatcacgcaccacgccgtgtcccggggcagcgccaagctgcagtggttcgtggagcgcaacatggtcatcccggaggggcgggtgatcgacctcggctgcgggcgcggcgggtggtcctactactgcgccggcctgaagaaggtgaccgaggtccgcggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccggaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacgcacgagatgtactggatcagcaacggcaccgggaacatcgtggcctccgtgaacatggtcagccggctcctgctgaaccgcttcaccatgacccaccggcgcccgacgatcgagaaggacgtggacctcggcgcgggcacccggcacgtgaacgccgagcccgagacccccaacatggacgtcatcggggagcgcatcaagcggatcaaggaggagcacaactccacctggcactacgacgacgagaacccgtacaagacgtgggcctaccacggcagctacgaggtgaaggccaccgggtccgccagcagcatgatcaacggcgtggtcaagctgctgaccaagccctgggacgtggtccccatggtgatccagatggcgatgaccgacacgacccccttcgggcagcagcgcgtgttcaaggagaaggtcgacacccggaccccgcgctccatgcccggcacgcggcgcgtgatgggcatcaccgccgagtggctctggcggaccctggggcgcaacaagaagccccgcctgtgcacccgggaggagttcacgaagaaggtgcgcaccaacgccgccatgggcgcggtcttcaccgaggagaaccagtgggacagcgccaaggccgccgtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacaccgcggggtgggacacgcgcatcaccgaggacgacctgcacaacgaggagaagatcacccagcagatggacccggagcaccggcagctcgccaacgccatcttcaagctgacctaccagaacaaggtggtcaaggtgcagcgccccacgcccaccggcaccgtgatggacatcatctcccggaaggaccagcgcggcagcgggcaggtcggcacctacgggctgaacaccttcacgaacatggaggcccagctcatccggcagatggagggcgagggggtgctgtccaaggccgacctggagaacccccacctcagcgagaagaagatcacccagtggctggagaccaagggcgtggagcgcctgaagcggatggcgatctccggcgacgactgcgtcgtgaagccgatcgacgaccgcttcgccaacgccctcctggccctgaacgacatggggaaggtgcggaaggacatcccccagtggcagcccagcaagggctggcacgactggcagcaggtccccttctgctcccaccacttccacgagctcatcatgaaggacgggcgcaagctggtggtgccgtgccggccccaggacgagctgatcggccgcgcccgcatcagccagggggcgggctggtccctccgggagaccgcctgcctgggcaaggcctacgcccagatgtggagcctgatgtacttccaccgccgggacctccgcctggcgtccaacgccatctgcagcgccgtccccgtgcactgggtgcccacgagccggaccacctggtccatccacgcccaccaccagtggatgaccacggaggacatgctgaccgtctggaaccgcgtgtggatcgaggacaacccgtggatggaggacaagacccccgtgaccacgtgggagaacgtcccctacctcgggaagcgggaggaccagtggtgcggcagcctgatcgggctgacctcccgcgccacctgggcgcagaacatccccaccgccatccagcaggtccggagcctcatcggcaacgaggagttcctggactacatgccgtccatgaagcgcttccggaaggaggaggagagcgagggggccatctggtga

SEQ ID NO: 9905 - RNA, 9873 nt, synthetic construct
  misc_feature 1..9873: note = derived and/or modified CDS sequence (opt1) from DENV-3__GU131878__SS-prME
  source 1..9873: mol_type = other RNA
accagcctgtgcctgatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcaccccgggttcaccatcctcgcgctgttcctggcccactacatcggcacctccctcacccagaaggtggtgatcttcatcctgctgatgctcgtgacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgcccgaggagcaggaccagaactacgtctgcaagcacacctacgtggaccgcgggtggggcaacgggtgcggcctcttcgggaagggctccctggtgacctgcgccaagttccagtgcctggagctcatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctgcccgagtacggcaccctcgggctggagtgcagcccccggaccggcctggacttcaacgagatgatcctcctgacgatgaagaacaaggcctggatggtgcaccgccagtggttcttcgacctgccgctcccctggaccagcggcgccaccaccgagacgcccacctggaaccggaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccgcctcaagatggacaagctggagctgaagggcatgagctacgccatgtgcaccaacacgttcgtcctcaagaaggaggtgtccgagacccagcacgggaccatcctgatcaaggtggagtacaagggcgaggacgcgccctgcaagatcccgttcagcaccgaggacgggcagggcaaggcccacaacggccggctgatcacggccaaccccgtcgtgaccaagaaggaggagcccgtgaacatcgaggccgagcccccgttcggggagagcaacatcgtcatcggcaccggggacaacgcgctgaagatcaactggtacaagaagggctccagcatcgggaagatgttcgaggccaccgcccgcggcgcccggcgcatggccatcctcggcgacacggcgtgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcggacatggggtgcgtcatcaactggaagggcaaggagctcaagtgcggcagcgggatcttcgtgaccaacgaggtgcacacctggaccgagcagtacaagttccaggccgactcccccaagcgcctggccacggccatcgccggcgcgtgggagaacggggtctgcggcatccggagcaccacccgcatggagaacctgctctggaagcagatcgccaacgagctgaactacatcctgtgggagaacaacatcaagctcaccgtggtggtcggggacatcatcggcgtgctggagcagggcaagcggacgctgacgccccagcccatggagctcaagtactcctggaagacctgggggaaggccaagatcgtgaccgccgagacgcagaacagctccttcatcatcgacggcccgaacacccccgagtgccccagcgcgtcccgcgcctggaacgtctgggaggtggaggactacgggttcggcgtgttcaccaccaacatctggctgaagctgcgggaggtctacacccagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacgtgcacctggcccaagtcccacaccctgtggagcaacggcgtgctggagtccgacatgatcatccccaagtccctcgccgggcccatctcccagcacaaccaccgccccggctaccacacccagacggccgggccgtggcacctgggcaagctggagctcgacttcaactactgcgagggcaccaccgtggtcatcaccgagaactgcgggacgcggggccccagcctgcgcaccaccaccgtgtccgggaagctgatccacgagtggtgctgccggagctgcacgctgccgcccctccgctacatgggcgaggacgggtgctggtacggcatggagatccggccgatctccgagaaggaggagaacatggtcaagagcctggtctccgccggcagcgggaaggtggacaacttcaccatgggcgtgctctgcctggcgatcctgttcgaggaggtcatgcgcgggaagttcggcaagaagcacatgatcgccggggtgttcttcaccttcgtgctcctgctgtccggccagatcacctggcgggacatggcccacacgctcatcatgatcggcagcaacgcctccgaccgcatggggatgggcgtcacctacctggccctgatcgcgaccttcaagatccagcccttcctcgccctggggttcttcctgcggaagctcaccagccgcgagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatgttcaccctgacggtggcctggcggaccgcgaccctcatcctggccggggtcagcctgctccccgtgtgccagtccagctccatgcgcaagaccgactggctgccgatggccgtcgccgccatgggcgtgccgcccctgcccctcttcatcttcagcctgaaggacacgctgaagcgccggtcctggccgctcaacgagggggtgatggcggtcggcctggtgagcatcctggcctccagcctcctgcgcaacgacgtgcccatggccggccccctggtcgccgggggcctcctgatcgcctgctacgtgatcaccgggacctccgcggacctgaccgtggagaaggccgccgacatcacgtgggaggaggaggccgagcagaccggcgtcagccacaacctcatgatcaccgtggacgacgacgggaccatgcggatcaaggacgacgagaccgagaacatcctgacggtgctgctcaagaccgccctgctgatcgtctccggcgtgttcccctacagcatcccggcgaccctcctggtgtggcacacctggcagaagcagacgcagcgctccggcgtcctgtgggacgtgccctccccgcccgagacccagaaggccgagctcgaggagggggtgtaccggatcaagcagcagggcatcttcgggaagacccaggtcggcgtgggggtgcagaaggagggcgtcttccacaccatgtggcacgtgacgcgcggcgccgtgctgacctacaacgggaagcggctggagccgaactgggcctccgtcaagaaggacctcatcagctacggcgggggctggcgcctgtccgcgcagtggcagaagggggaggaggtccaggtgatcgccgtcgagcccggcaagaaccccaagaacttccagaccatgcccggcaccttccagacgaccaccggggagatcggcgccatcgccctggacttcaagccggggaccagcggcagccccatcatcaaccgggagggcaaggtggtggggctgtacggcaacggggtcgtgacgaagaacggcgggtacgtgtccggcatcgcccagaccaacgcggagcccgacggcccgacccccgagctcgaggaggagatgttcaagaagcgcaacctgaccatcatggacctgcaccccgggagcggcaagacgcggaagtacctccccgccatcgtccgcgaggccatcaagcggcgcctgcggaccctgatcctcgccccgacccgcgtggtggccgcggagatggaggaggccctgaaggggctgcccatccggtaccagaccacggccaccaagtccgagcacaccggccgcgagatcgtcgacctcatgtgccacgccaccttcacgatgcggctgctgagccccgtgcgcgtgcccaactacaacctcatcatcatggacgaggcccacttcaccgacccggcgtccatcgccgcccgggggtacatcagcacccgcgtcggcatgggcgaggccgcggccatcttcatgaccgccacgccgcccgggaccgccgacgccttcccccagtccaacgcgccgatccaggacgaggagcgcgacatccccgagcggagctggaactccggcaacgagtggatcaccgacttcgccgggaagaccgtgtggttcgtgcccagcatcaaggccggcaacgacatcgccaactgcctgcgcaagaacgggaagaaggtcatccagctgtcccggaagacgttcgacaccgagtaccagaagaccaagctcaacgactgggacttcgtggtgaccacggacatcagcgagatgggcgccaacttcaaggcggaccgcgtcatcgacccccggcgctgcctgaagccggtgatcctgaccgacggccccgagcgggtgatcctcgccgggcccatgcccgtcaccgccgcctccgccgcgcagcgccggggccgcgtggggcggaacccgcagaaggagaacgaccagtacatcttcaccggccagcccctgaacaacgacgaggaccacgcccactggaccgaggccaagatgctgctcgacaacatcaacacgcccgaggggatcatccccgccctgttcgagccggagcgcgagaagtccgcggccatcgacggcgagtaccggctgaagggcgagtcccgcaagaccttcgtggagctcatgcggcgcggggacctgcccgtctggctggcccacaaggtggccagcgagggcatcaagtacaccgaccggaagtggtgcttcgacgggcagcgcaacaaccagatcctcgaggagaacatggacgtcgagatctggaccaaggagggcgagaagaagaagctgcggccccgctggctggacgcccgcacgtactccgaccccctcgcgctgaaggagttcaaggacttcgccgccggccgcaagagcatcgccctggacctcgtgaccgagatcgggcgcgtgccgtcccacctggcccaccggacccgcaacgcgctggacaacctcgtcatgctgcacaccagcgagcacggcgggcgggcctaccgccacgccgtggaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggcggccatccccctgcagtggatcgccagcgccatcgtcctcgagttcttcatgatggtgctgctgatcccggagcccgagaagcagcggacgccccaggacaaccagctcgcctacgtggtcatcgggatcctgaccctggcggccatcatcgccgccaacgagatgggcctcctggagaccaccaagcgcgacctgggcatgtccaaggagcccggggtggtgagcccgacgtcctacctcgacgtcgacctgcaccccgcgagcgcctggaccctgtacgccgtggccaccaccgtgatcacgcccatgctccggcacaccatcgagaactccaccgccaacgtcagcctggcggccatcgccaaccaggccgtggtgctgatgggcctcgacaaggggtggcccatctccaagatggacctgggcgtcccgctgctcgccctggggtgctacagccaggtgaaccccctgaccctcacggcggccgtgctgctgctcatcacccactacgccatcatcggccccggcctgcaggccaaggccacccgcgaggcgcagaagcggaccgccgccgggatcatgaagaaccccacggtcgacggcatcatgaccatcgacctggacccggtgatctacgactccaagttcgagaagcagctcggccaggtgatgctgctggtcctctgcgccgtgcagctgctgctcatgcgcaccagctgggcgctgtgcgaggccctgaccctcgccacgggccccatcaccaccctgtgggagggctcccccgggaagttctggaacaccacgatcgccgtgagcatggccaacatcttccggggctcctacctggcgggggccggcctcgccttcagcatcatgaagtccgtcgggaccggcaagcgcggcaccgggagccagggcgagaccctgggggagaagtggaagaagaagctgaaccagctcagccggaaggagttcgacctgtacaagaagtccggcatcaccgaggtggaccgcacggaggccaaggaggggctgaagcggggcgagatcacccaccacgccgtgagccgcggctccgcgaagctccagtggttcgtcgagcggaacatggtgatccccgaggggcgcgtgatcgacctgggctgcgggcggggcgggtggagctactactgcgccggcctgaagaaggtcaccgaggtgcgcggctacaccaagggcgggccggggcacgaggagcccgtgcccatgtccacgtacggctggaacatcgtcaagctcatgagcgggaaggacgtgttctacctgcccccggagaagtgcgacaccctgctgtgcgacatcggcgagtccagcccctcccccaccgtggaggagagccgcaccatccgggtcctcaagatggtggagccctggctgaagaacaaccagttctgcatcaaggtgctgaacccgtacatgcccacggtcatcgagcacctcgagcgcctgcagcggaagcacggcgggatgctggtgcgcaaccccctctcccggaacagcacccacgagatgtactggatctccaacggcaccgggaacatcgtggccagcgtcaacatggtgtcccgcctgctgctcaaccggttcaccatgacgcaccgccggcccaccatcgagaaggacgtggacctgggcgccggcacccgccacgtcaacgccgagccggagacccccaacatggacgtgatcggggagcggatcaagcgcatcaaggaggagcacaacagcacgtggcactacgacgacgagaacccctacaagacctgggcgtaccacggctcctacgaggtgaaggccaccgggagcgcctccagcatgatcaacggcgtcgtgaagctgctcaccaagccgtgggacgtcgtgcccatggtgacgcagatggccatgaccgacaccacccccttcgggcagcagcgggtcttcaaggagaaggtggacacgcgcacgccccggagcatgccgggcacccgccgggtgatgggcatcaccgcggagtggctgtggcgcaccctggggcggaacaagaagccccgcctctgcacccgcgaggagttcaccaagaaggtccggaccaacgccgccatgggcgccgtgttcacggaggagaaccagtgggactccgccaaggcggccgtggaggacgaggacttctggaagctggtcgaccgcgagcgggagctgcacaagctcgggaagtgcggcagctgcgtgtacaacatgatggggaagcgcgagaagaagctgggcgagttcggcaaggccaaggggtcccgggccatctggtacatgtggctgggcgcccgctacctcgagttcgaggcgctggggttcctgaacgaggaccactggttcagccgggagaactcctacagcggcgtggagggggagggcctccacaagctgggctacatcctgcgcgacatctccaagatccccgggggcgccatgtacgccgacgacaccgccgggtgggacacccggatcaccgaggacgacctccacaacgaggagaagatcacgcagcagatggaccccgagcaccgccagctggccaacgcgatcttcaagctgacctaccagaacaaggtcgtgaaggtgcagcggccgacccccaccggcaccgtcatggacatcatcagccgcaaggaccagcggggctccggccaggtgggcacgtacgggctcaacaccttcaccaacatggaggcccagctgatccgccagatggagggcgagggggtgctgagcaaggccgacctcgagaacccccacctccccgagaagaagatcacccagtggctggagacgaagggcgtcgagcggctcaagcgcatggccatctccggcgacgactgcgtggtgaagccgatcgacgaccggttcgccaacgcgctgctggccctcaacgacatggggaaggtccgcaaggacatcccccagtggcagcccagcaagggctggcacgactggcagcaggtccccttctgctcccaccacttccacgagctgatcatgaaggacgggcggaagctggtggtcccgtgccgcccccaggacgagctcatcggccgggcccgcatcagccagggggccggctggtccctgcgcgagaccgcgtgcctgggcaaggcctacgcccagatgtggagcctcatgtacttccaccggcgcgacctgcggctggcctccaacgccatctgcagcgcggtgcccgtgcactgggtccccacctcccgcaccacgtggagcatccacgcccaccaccagtggatgaccaccgaggacatgctcaccgtgtggaaccgggtgtggatcgaggacaacccgtggatggaggacaagacgcccgtcaccacctgggagaacgtgccctacctggggaagcgcgaggaccagtggtgcggcagcctgatcgggctcacctcccgggccacgtgggcccagaacatccccaccgccatccagcaggtccgcagcctgatcggcaacgaggagttcctggactacatgccgtccatgaagcggttccgcaaggaggaggagagcgagggggcgatctggtga

SEQ ID NO: 9906 - RNA, 9873 nt, synthetic construct
  misc_feature 1..9873: note = derived and/or modified CDS sequence (opt1) from DENV-3__FJ898455__SS-prME
  source 1..9873: mol_type = other RNA
accagcctgtgcctcatgatgatgctgcccgccaccctggccttccacctcaccagccgcgacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacccagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtgtgggaggtcgaggactacgggttcggcgtgttcacgaccaacatctggctgaagctgcgggagatgtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtgctctgcctggccatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtgacctacctggccctcatcgccacgttcaagatccagcccttcctggccctggggttcttcctccggaagctgaccagccgcgagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcttcacgctcaccgtggcctggcggaccgccaccctgatcctggccgtcatcagcctcctgcccgtgtgccagtccagctccatgcgcaagacggactggctgccgatgaccgtggccgcgatgggggtgccgcccctccccctgttcatcttcagcctgaaggacaccctcaagcggcgctcctggccgctgaacgagggcgtgatggccgtcgggctggtgagcatcctcgcctccagcttcctgcgcaacgacgtgcccatggccggccccctggtcgccggcgggctcctgatcgcgtgctacgtgatcaccggcacgtccgccgacctgaccgtggagaaggccgccgacgtcacctgggaggaggaggccgagcagaccggggtgagccacaacctcatgatcacggtggacgacgacggcaccatgcggatcaaggacgacgagaccgagaacatcctgaccgtcctgctcaagaccgcgctgctgatcgtgtccgggatcttcccctacagcatcccggccacgctcctggtgtggcacacctggcagaagcagacccagcgctccggcgtcctgtgggacgtgccctccccgcccgagacccagaaggccgagctcgaggagggcgtgtaccggatcaagcagcaggggatcttcggcaagacgcaggtcggggtgggcgtgcacaaggagggggtcttccacaccatgtggcacgtgacccgcggcgccgtgctgacccacaacggcaagcggctggagccgaactgggcgaacgtcaagaaggacctcatctcctacgggggcgggtggaagctgagcgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgtccgggagccccatcatcaaccgcgagggcaaggtggtgggcctgtacgggaacggcgtcgtgaccaagaacgggggctacgtgagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtccgggaggccatcaagcgccggctgcgcaccctgatcctcgccccgacccgggtggtggcggccgagatggaggaggccctgaagggcctgcccatccgctaccagacgaccgccaccaagagcgagcacaccgggcgggagatcgtcgacctcatgtgccacgccacgttcaccatgcgcctgctgtcccccgtgcgggtgcccaactacaacctcatcgtcatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtgtggttcgtcccctccatcaaggccgggaacgacatcgccaactgcctgcgcaagaacggcaagaaggtgatccagctgagccgcaagaccttcgacaccgagtaccagaagaccaagctcaacgactgggacttcgtggtcacgaccgacatctccgagatgggggcgaacttcaaggccgaccgggtgatcgacccccgccggtgcctgaagccggtgatcctgaccgacggccccgagcgcgtcatcctcgccggccccatgcccgtgaccgtggccagcgccgcgcagcggcgcgggcgggtcggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtgtggctggcccacaaggtcgcctccgaggggatcaagtacaccgaccgcaagtggtgcttcgacggcgagcggaacaaccagatcctcgaggagaacatggacgtggagatctggacgaaggagggggagcgcaagaagctgcggccccgctggctggacgcccggacctacagcgaccccctcgcgctgaaggagttcaaggacttcgccgccggccgcaagtccatcgccctggacctcgtcaccgagatcggccgcgtgccgagccacctggcccaccggacccgcaacgcgctggacaacctcgtgatgctgcacacgtccgagcacgggggccgggcctaccgccacgccgtcgaggagctgcccgagaccatggagaccctcctgctgctcgggctgatgatcctgctcaccggcggggccatgctgttcctgatcagcggcaagggcatcgggaagacgagcatcggcctcatctgcgtggtggcctccagcgggatgctgtggatggcggacgtccccctgcagtggatcgcctccgccatcgtgctcgagttcttcatgatggtgctgctgatcccggagcccgagaagcagcggacgccccaggacaaccagctcgcctacgtcgtgatcggcatcctgaccctggccgcgatcgtggccgccaacgagatggggctcctggagaccacgaagcgcgacctgggcatgagcaaggagcccggcgtcgtgtccccgaccagctacctcgacgtggacctgcaccccgcctccgcgtggaccctgtacgccgtcgccaccacggtgatcacccccatgctccggcacaccatcgagaacagcaccgccaacgtgtccctggccgcgatcgccaaccaggccgtcgtgctgatggggctcgacaagggctggcccatcagcaagatggacctgggggtgccgctgctcgccctgggctgctactcccaggtcaaccccctgacgctcaccgccgcggtgctgctgctcgtgacccactacgccatcatcgggcccggcctgcaggccaaggccacccgcgaggcccagaagcggacggcggccggcatcatgaagaaccccaccgtcgacgggatcatgaccatcgacctggacccggtgatctacgacagcaagttcgagaagcagctcggccaggtgatgctgctggtcctctgcgccgtgcagctgctgctcatgcgcacctcctgggccttctgcgaggcgctgacgctggccaccgggcccatcaccaccctctgggagggcagccccggcaagttctggaacacgaccatcgccgtgtccatggccaacatcttccgggggagctacctggccggcgcggggctggccttctccatcatgaagtccgtcggcaccgggaagcgcggcaccggctcccagggggagacgctcggcgagaagtggaagaagaagctgaaccagctgagccggaaggagttcgacctctacaagaagtccgggatcaccgaggtggaccgcaccgaggccaaggagggcctgaagcgcggggagatcacccaccacgccgtgtcccgcggcagcgccaagctgcagtggttcgtcgagcggaacatggtgatccccgagggccgcgtgatcgacctcgggtgcggccgcgggggctggtcctactactgcgcggggctgaagaaggtcaccgaggtgcgcggctacacgaagggcgggccgggccacgaggagcccgtgcccatgagcacctacgggtggaacatcgtcaagctgatgtccggcaaggacgtgttctacctcccgcccgagaagtgcgacaccctgctgtgcgacatcggggagagctcccccagccccaccgtggaggagtcccggacgatccgcgtcctgaagatggtggagccctggctcaagaacaaccagttctgcatcaaggtgctgaacccctacatgcccaccgtcatcgagcacctggagcgcctccagcggaagcacggcggcatgctggtgcgcaaccccctgagccggaactccacccacgagatgtactggatcagcaacgggaccggcaacatcgtgtccagcgtcaacatggtgtcccgcctcctgctgaaccggttcacgatgacccaccgccggcccaccatcgagaaggacgtggacctcggggccggcacccgccacgtcaacgccgagccggagacgcccaacatggacgtgatcggcgagcggatccgccggatcaaggaggagcacagctccacctggcactacgacgacgagaacccctacaagacctgggcctaccacgggagctacgaggtcaaggccaccggctccgcgagcagcatgatcaacggggtggtgaagctgctgacgaagccgtgggacgtcgtgcccatggtgacccagatggccatgaccgacaccacgcccttcggccagcagcgcgtcttcaaggagaaggtggacacccggacgccccggccgatgcccgggacccggaaggtgatggagatcacggccgagtggctctggcgcaccctgggccggaacaagcgcccccggctgtgcacccgcgaggagttcatcaagaaggtccgcaccaacgccgcgatgggcgccgtgttcacggaggagaaccagtgggactccgcccgggccgccgtggaggacgaggagttctggaagctcgtcgaccgcgagcgggagctgcacaagctggggaagtgcggcagctgcgtgtacaacatgatggggaagcgcgagaagaagctcggcgagttcgggaaggcgaagggctcccgggccatctggtacatgtggctgggcgcccgctacctggagttcgaggccctcgggttcctgaacgaggaccactggttcagccgggagaactcctacagcggcgtggagggggagggcctgcacaagctcgggtacatcctgcgcgacatctccaagatccccggcggcgccatgtacgcggacgacaccgccgggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaagggcaccgtcatggacatcatcagccgcaaggaccagcgggggtccggccaggtgggcacgtacgggctgaacaccttcaccaacatggaggcccagctcatccgccagatggagggcgagggggtgctgagcaaggcggacctggagaacccccacctcctggagaagaaggtcacccagtggctggagaccaagggcgtggagcggctcaagcgcatggccatctccggggacgactgcgtggtcaagccgatcgacgaccggttcgccaacgccctgctggccctcaacgacatgggcaaggtgcgcaaggacatcccccagtggcagcccagcaagggctggcacgactggcagcaggtccccttctgctcccaccacttccacgagctgatcatgaaggacgggcggaagctggtcgtgccgtgccgcccccaggacgagctcatcggccgggcgcgcatcagccagggggccggctggtccctgcgcgagacggcctgcctggggaaggcctacgcgcagatgtgggccctcatgtacttccaccggcgcgacctgcggctggccagcaacgccatctgctccgccgtgcccgtccactgggtgcccaccagccgcaccacctggtccatccacgcgcaccaccagtggatgacgaccgaggacatgctcaccgtgtggaaccgggtctggatcgaggacaacccgtggatggaggacaagacccccgtgacgacctgggaggacgtgccctacctgggcaagcgcgaggaccagtggtgcggcagcctgatcgggctcaccagccgggccacctgggcccagaacatcctgacggccatccagcaggtccgctccctgatcggcaacgaggagttcctcgactacatgcccagcatgaagcggttccgcaaggaggaggagtccgagggggccatctggtga

SEQ ID NO: 9907 - RNA, 9873 nt, synthetic construct
  misc_feature 1..9873: note = derived and/or modified CDS sequence (opt1) from DENV-3__GQ199891__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtgggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcggggaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatgaccgtcgccgccatgggcgtgccgcccctcccgctgttcatcttcagcctcaaggacacgctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacgtcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgcggccggccgcaagagcatcgccctggacctggtgaccgagatcgggcgggtgcccacccacctcgcccaccgcacccggaacgccctggacaacctggtcatgctccacacgtccgagcacggcgggaaggcgtaccgccacgccgtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagaccacgaagcgcgacctgggcatgagcaaggagccgggggtggtgtcccccaccagctacctggacgtcgacctccaccccgcctccgcctggaccctgtacgcggtggccaccacggtgatcacccccatgctgcggcacaccatcgagaacagcaccgccaacgtctccctcgccgccatcgcgaaccaggccgtggtgctgatgggcctggacaaggggtggccgatcagcaagatggacctcggcgtccccctgctggccctcgggtgctactcccaggtgaaccccctgacgctgaccgccgccgtgctcctgctgatcacccactacgcgatcatcggccccggcctccaggccaaggccacccgcgaggcccagaagcggacggccgcggggatcatgaagaacccgaccgtcgacggcatcatgaccatcgacctggaccccgtgatctacgacagcaagttcgagaagcagctgggccaggtgatgctcctggtcctgtgcgccgtgcagctcctgctgatgcgcacctcctgggccctctgcgaggccctgacgctggcgaccggccccatcaccaccctctgggagggcagccccgggaagttctggaacacgaccatcgccgtgtccatggccaacatcttccggggcagctacctggccggggccggcctggcgttctccatcatgaagtccgtcgggaccggcaagcgcggcaccgggtcccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcaccgaggtgcgcggctacacgaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcaccgggaacatcgtggcgtccgtcaacatggtgagccgcctcctgctgaaccggttcacgatgacccaccgccggccgaccatcgagaaggacgtggacctcggcgccggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggccaccgggtccgcgagctccatgatcaacggcgtcgtgaagctgctgacgaagccctgggacgtcgtgcccatggtgacccagatggccatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgggaggagttcaccaagaaggtccgcacgaacgccgcgatgggcgccgtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatctcccgcaaggaccagcggggcagcggccaggtgggcacctacgggctgaacaccttcaccaacatggaggcccagctcatccgccagatggagggcgagggggtgctgtccaaggcggacctggagaacccccacctcccggagaagaagatcacgcagtggctggagaccaagggcgtcgagcggctgaagcgcatggccatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcgggaagcgcgaggaccagtggtgcggcagcctgatcgggctgacgagccgggcgacctgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 9908 - RNA, 9873 nt, synthetic construct
  misc_feature 1..9873: note = derived and/or modified CDS sequence (opt1) from DENV-3__FJ898443__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtgggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcaccggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacacgctgatcatgatcggcagcaacgcctccgaccggatggggatgggcgtcacctacctcgccctgatcgcgaccttcaagatccagcccttcctggccctcgggttcttcctgcgcaagctgaccagccgggagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcgcaccgcgaccctgatcctcgccggggtcagcctgctgccggtgtgccagtccagctccatgcggaagaccgactggctccccatgacggtcgccgccatgggcgtgccgcccctcccgctgttcatcttcagcctcaaggacaccctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgacggtggagaaggcggccgacgtcacctgggaggaggaggccgagcagaccggcgtgagccacaacctgatgatcaccgtggacgacgacgggaccatgcgcatcaaggacgacgagacggagaacatcctcaccgtcctgctgaagaccgccctcctgatcgtgtccggcatcttcccgtacagcatccccgccaccctgctcgtgtggcacacgtggcagaagcagacccagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacacgatgtggcacgtgacccggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtccgggaggccatcaagcgccggctccgcaccctgatcctggcccccacccgggtggtggccgccgagatggaggaggcgctcaaggggctgcccatccgctaccagacgaccgccaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtgtggttcgtgcccagcatcaaggccggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccggtggctggacgcccgcacctactccgacccgctggccctcaaggagttcaaggacttcgcggccggccgcaagagcatcgccctggacctggtgaccgagatcgggcgggtgcccacccacctcgcccaccgcacgcggaacgccctggacaacctggtcatgctccacacctccgagcacggcgggaaggcgtaccgccacgccgtggaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagacgaccaagcgcgacctgggcatgagcaaggagccgggggtggtgtcccccaccagctacctggacgtcgacctccaccccgcctccgcctggaccctgtacgcggtggccacgaccgtgatcacccccatgctgcggcacaccatcgagaacagcacggccaacgtctccctcgccgccatcgcgaaccaggccgtggtgctgatgggcctggacaaggggtggccgatcagcaagatggacctcggcgtccccctgctggccctcgggtgctactcccaggtgaaccccctgaccctgaccgccgccgtgctcctgctgatcacccactacgcgatcatcggccccggcctccaggccaaggccacgcgcgaggcccagaagcggaccgccgcggggatcatgaagaacccgaccgtcgacggcatcatgaccatcgacctggaccccgtgatctacgacagcaagttcgagaagcagctgggccaggtgatgctcctggtcctgtgcgccgtgcagctcctgctgatgcgcacgtcctgggccctctgcgaggccctgaccctggcgaccggccccatcaccacgctctgggagggcagccccgggaagttctggaacaccaccatcgccgtgtccatggccaacatcttccggggcagctacctggccggggccggcctggcgttctccatcatgaagtccgtcgggaccggcaagcgcggcaccgggtcccagggcgagacgctcggggagaagtggaagatgaagctgaaccagctgagccggaaggagttcgacctctacaagaagtccggcatcaccgaggtggaccgcaccgaggccaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcacggaggtgcgcggctacaccaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccacggtggaggagtcccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcacggggaacatcgtggcgtccgtcaacatggtgagccgcctcctgctgaaccggttcaccatgacccaccgccggccgaccatcgagaaggacgtggacctcggcgccggcacgcgccacgtcaacgccgagcccgagacccccaacatggacgtgatcggggagcggatcaagcgcatcaaggaggagcacaactccacctggcactacgacgacgagaacccgtacaagacctgggcctaccacggcagctacgaggtgaaggccacggggtccgcgagctccatgatcaacggcgtcgtgaagctgctgaccaagccctgggacgtcgtgcccatggtgacccagatggccatgaccgacacgacccccttcgggcagcagcgggtcttcaaggagaaggtggacacccgcaccccgcggagcatgcccggcacgcgccgggtgatgggcatcaccgccgagtggctctggcgcaccctggggcggaacaagaagccccgcctgtgcacccgggaggagttcacgaagaaggtccgcaccaacgccgcgatgggcgccgtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacgcggatcaccgaggacgacctgcacaacgaggagaagatcacccagcagatggacccggagcaccgccagctcgccaacgccatcttcaagctgacctaccagaacaaggtcgtgaaggtgcagcggcccacccccacgggcaccgtcatggacatcatctcccgcaaggaccagcggggcagcggccaggtgggcacctacgggctgaacaccttcacgaacatggaggcccagctcatccgccagatggagggcgagggggtgctgtccaaggcggacctggagaacccccacctcccggagaagaagatcacccagtggctggagaccaagggcgtcgagcggctgaagcgcatggccatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtgcccgtgcactgggtcccgacgagccgcaccacctggtccatccacgcccaccaccagtggatgaccacggaggacatgctgaccgtgtggaaccgggtgtggatcgaggacaacccctggatggaggacaagacccccgtcaccacgtgggagaacgtgccctacctcgggaagcgcgaggaccagtggtgcggcagcctgatcgggctgaccagccgggcgacctgggcccagaacatcccgaccgccatccagcaggtccgctccctcatcggcaacgaggagttcctggactacatgcccagcatgaagcggttccgcaaggaggaggagctggagggggccatctggtga

SEQ ID NO: 9909 - RNA, 9873 nt, synthetic construct
  misc_feature 1..9873: note = derived and/or modified CDS sequence (opt1) from DENV-3__FJ898444__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgggacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgagcaggggaaggcccacaacggccgcctgatcacggccaaccccgtcgtgaccaagaaggaggagcccgtgaacatcgaggccgagccgcccttcggcgagagcaacatcgtcatcgggatcggcgacaacgcgctgaagatcaactggtacaagaaggggtccagcatcggcaagatgttcgaggccaccgcccgcggggcccgccggatggccatcctgggcgacaccgcgtgggacttcggctccgtcgggggcgtgctcaacagcctggggaagatggtccaccagatcttcggctccgcctacacggccctgttcagcggggtgtcctgggtgatgaagatcggcatcggcgtcctcctgacctggatcgggctgaacagcaagaacacctccatgagcttctcctgcatcgccatcggcatcatcaccctctacctgggggccgtggtgcaggcggacatgggctgcgtcgtgaactggaaggggaaggagctgaagtgcggcagcggcatcttcgtgacgaacgaggtccacacctggaccgagcagtacaagttccaggccgactcccccaagcgcctcgccaccgccatcgccggggcgtgggagaacggcgtgtgcgggatccgcagcacgacccggatggagaacctgctgtggaagcagatcgccaacgagctcaactacatcctgtgggagaacaacatcaagctgaccgtggtcgtgggcgacatcatcggggtgctcgagcagggcaagcgcaccctgacgccccagccgatggagctgaagtactcctggaagacctggggcaaggccaagatcgtcaccgccgagacccagaacagctccttcatcatcgacgggcccaacacgcccgagtgccccagcgcgtcccgggcctggaacgtgtgggaggtggaggactacggcttcggggtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacggctcctggaagctggagaaggccagcctgatcgaggtgaagacctgcacgtggccgaagtcccacaccctctggagcaacggggtgctggagtccgacatgatcatccccaagagcctggccggccccatctcccagcacaactaccggccggggtaccacacccagaccgccggcccctggcacctcgggaagctggagctggacttcaactactgcgagggcacgaccgtcgtgatcaccgagaactgcggcacccgcgggcccagcctccggacgaccaccgtgtccggcaagctgatccacgagtggtgctgccgcagctgcaccctgcccccgctccggtacatgggggaggacggctgctggtacgggatggagatccgccccatctccgagaaggaggagaacatggtcaagagcctggtgtccgccggcagcggcgaggtggacaacttcacgatgggggtcctgtgcctcgcgatcctgttcgaggaggtgatgcggggcaagttcgggaagaagcacatgatcgccggcgtgttcttcaccttcgtcctgctcctgtccgggcagatcacctggcgcgacatggcccacaccctgatcatgatcggcagcaacgcctccgaccggatgggcatgggggtgacgtacctcgccctgatcgcgaccttcaagatccagcccttcctggccctcggcttcttcctgcgcaagctgaccagccgggagaacctcctgctgggggtgggcctcgccatggccaccacgctgcagctgcccgaggacatcgagcagatggcgaacggcatcgccctcgggctgatggccctgaagctcatcacccagttcgagacctaccagctgtggaccgccctgatcagcctcacgtgctccaacaccatcttcaccctgaccgtcgcctggcgcacggcgaccctgatcctcgccggcgtgagcctgctgccggtctgccagtccagctccatgcggaagaccgactggctccccatgaccgtggccgccatgggggtgccgcccctcccgctgttcatcttcagcctcaaggacacgctgaagcgccgctcctggcccctgaacgagggcgtcatggccgtggggctcgtgagcatcctggcgtccagcctgctccggaacgacgtccccatggccggccccctggtggccggcgggctgctcatcgcctgctacgtgatcaccggcacctccgccgacctgaccgtcgagaaggcggccgacgtgacgtgggaggaggaggccgagcagaccggggtgagccacaacctgatgatcaccgtcgacgacgacggcaccatgcgcatcaaggacgacgagaccgagaacatcctcacggtgctgctgaagaccgccctcctgatcgtgtccgggatcttcccgtacagcatccccgccaccctgctcgtctggcacacctggcagaagcagacgcagcggtccggcgtgctgtgggacgtgcccagcccgcccgagacccagaaggcggagctggaggagggcgtctaccgcatcaagcagcaggggatcttcggcaagacccaggtgggggtgggcgtccagaaggagggggtgttccacaccatgtggcacgtgacgcggggcgccgtcctcacctacaacggcaagcgcctggagcccaactgggcctccgtgaagaaggacctgatcagctacgggggcgggtggcggctctccgcccagtggcagaagggcgaggaggtgcaggtcatcgcggtggagcccgggaagaaccccaagaacttccagaccatgcccggcaccttccagacgaccaccggcgagatcggggccatcgccctggacttcaagcccggcaccagcgggagccccatcatcaaccgcgagggcaaggtggtcggcctgtacgggaacggcgtggtgacgaagaacgggggctacgtctccgggatcgcccagaccaacgccgagccggacggccccacccccgagctggaggaggagatgttcaagaagcggaacctcaccatcatggacctgcaccccggcagcgggaagacgcgcaagtacctgccggcgatcgtgcgggaggccatcaagcgccggctccgcaccctgatcctggcccccacccgggtggtcgccgccgagatggaggaggcgctcaagggcctgcccatccgctaccagaccacggccaccaagtccgagcacaccgggcgggagatcgtggacctgatgtgccacgccaccttcacgatgcgcctcctgagccccgtgcgggtcccgaactacaacctgatcatcatggacgaggcccacttcaccgaccccgcctccatcgcggcccgcggctacatcagcacccgggtggggatgggcgaggccgccgcgatcttcatgaccgccacgccgcccggcaccgccgacgccttcccgcagtccaacgcccccatccaggacgaggagcgcgacatccccgagcgcagctggaactccgggaacgagtggatcaccgacttcgcgggcaagaccgtgtggttcgtccccagcatcaaggccgggaacgacatcgccaactgcctccggaagaacggcaagaaggtgatccagctgtcccgcaagacgttcgacaccgagtaccagaagaccaagctgaacgactgggacttcgtggtcaccacggacatcagcgagatgggggccaacttcaaggccgaccgggtgatcgacccgcgccggtgcctcaagcccgtgatcctgaccgacggccccgagcgcgtcatcctggcgggccccatgccggtgaccgccgcctccgccgcccagcggcgcgggcgggtgggccgcaacccccagaaggagaacgaccagtacatcttcaccgggcagcccctcaacaacgacgaggaccacgcgcactggaccgaggccaagatgctgctggacaacatcaacacgcccgagggcatcatcccggccctcttcgagcccgagcgggagaagtccgccgcgatcgacggggagtaccgcctgaagggcgagtcccggaagaccttcgtcgagctgatgcgccggggcgacctccccgtgtggctggcctacaaggtcgccagcgaggggatcaagtacaccgaccgcaagtggtgcttcgacggccagcggaacaaccagatcctggaggagaacatggacgtggagatctggaccaaggagggggagaagaagaagctccgcccccggtggctggacgcccgcacgtactccgacccgctggccctcaaggagttcaaggacttcgcggccggccgcaagagcatcgccctggacctggtgaccgagatcggccgggtccccacccacctcgcccaccgcacccggaacgccctggacaacctggtgatgctccacacgtccgagcacgggggcaaggcgtaccgccacgccgtggaggagctgcccgagaccatggagaccctgctcctgctggggctcatgatcctgctgaccggcggggccatgctgttcctgatcagcggcaagggcatcgggaagacgagcatcggcctgatctgcgtcatcgcctccagcgggatgctctggatggccgagatcccgctgcagtggatcgcgtccgccatcgtgctggagttcttcatgatggtgctcctgatccccgagcccgagaagcagcggacgccccaggacaaccagctggcctacgtcgtgatcggcatcctcaccctggccgccatcatcgcggccaacgagatggggctgctcgagaccacgaagcgcgacctgggcatgagccgggagccgggcgtggtctcccccaccagctacctggacgtggacctccaccccgcctccgcctggaccctgtacgcggtggccaccacggtcatcacccccatgctgcgccacaccatcgagaacagcaccgccaacgtgtccctcgccgccatcgcgaaccaggccgtggtcctgatggggctggacaagggctggccgatcagcaagatggacctcggggtgcccctgctggccctcggctgctactcccaggtgaaccccctgacgctgaccgccgccgtcctcctgctgatcacccactacgcgatcatcgggcccggcctccaggccaaggccacccgggaggcccagaagcgcacggccgcgggcatcatgaagaacccgaccgtggacgggatcatgaccatcgacctggaccccgtgatctacgacagcaagttcgagaagcagctgggccaggtcatgctcctggtgctgtgcgccgtgcagctcctgctgatgcggacctcctgggccctctgcgaggccctgacgctggcgaccgggcccatcaccaccctctgggagggcagccccggcaagttctggaacacgaccatcgccgtctccatggccaacatcttccgcgggagctacctggccggcgccgggctggcgttctccatcatgaagtccgtgggcaccgggaagcggggcaccggctcccagggggagaccctcggcgagaagtggaagaagaagctgaaccagctgagccgcaaggagttcgacctctacaagaagtccgggatcacggaggtggaccggaccgaggccaaggagggcctgaagaagggggagatcacccaccacgccgtctcccgcggcagcgccaagctgcagtggttcgtggagcggaacatggtgatcccggagggccgcgtcatcgacctcgggtgcggccgcgggggctggtcctactactgcgccgggctgaagaaggtgaccgaggtgcgcggctacacgaagggcgggcccggccacgaggagcccgtccccatgagcacctacgggtggaacatcgtgaagctgatgtccggcaaggacgtgttctacctcccgcccgagaagtgcgacaccctgctgtgcgacatcggggagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcggcatgctggtgcgcaaccccctgagccggaactccacccacgagatgtactggatcagcaacgggaccggcaacatcgtcgcgtccgtgaacatggtgagccgcctcctgctgaaccggttcacgatgacccaccgccggccgaccatcgagaaggacgtcgacctcggggccggcacccgccacgtgaacgccgagcccgagacgcccaacatggacgtgatcggcgagcggatcaagcgcatcaaggaggagcacaactccacctggcactacgacgacgagaacccgtacaagacctgggcctaccacgggagctacgaggtcaaggccaccggctccgcgagctccatgatcaacggggtggtcaagctgctgacgaagccctgggacgtggtgcccatggtcacccagatggccatgaccgacaccacgcccttcggccagcagcgggtgttcaaggagaaggtggacacccgcaccccgcggcccatgcccgggacccgccgggtcatgggcatcacggccgagtggctctggcgcaccctgggccggaacaagaagccccgcctgtgcacccgggaggagttcaccaagaaggtgcgcacgaacgccgcgatgggggccgtgttcaccgaggagaaccagtgggacagcgccaaggccgccgtcgaggacgaggacttctggaagctcgtggaccgcgagcgggagctgcacaagctgggcaagtgcgggagctgcgtgtacaacatgatgggcaagcgcgagaagaagctcggggagttcggcaaggcgaagggctcccgggccatctggtacatgtggctgggggcccgctacctggagttcgaggccctcggcttcctgaacgaggaccactggttcagccgggagaactcctacagcggggtcgagggcgaggggctgcacaagctcggctacatcctgcgcgacatctccaagatcccgggcggggccatgtacgcggacgacaccgccggctgggacacccggatcacggaggacgacctgcacaacgaggagaagatcacccagcagatggaccccgagcaccgccagctcgccaacgccatcttcaagctgacctaccagaacaaggtggtgaaggtccagcggcccacccccaccgggacggtgatggacatcatcagccgcaaggaccagcggggctccggccaggtggggacctacggcctgaacaccttcaccaacatggaggcccagctcatccgccagatggagggggagggcgtcctgagcaaggcggacctggagaacccgcacctccccgagaagaagatcacgcagtggctggagaccaagggggtggagcggctgaagcgcatggccatctccggcgacgactgcgtggtcaagcccatcgacgaccggttcgccaacgccctcctggccctgaacgacatgggcaaggtgcgcaaggacatcccccagtggcagccgagcaaggggtggcacgactggcagcaggtccccttctgctcccaccacttccacgagctcatcatgaaggacggccggaagctggtcgtgccctgccgcccccaggacgagctgatcgggcgggcgcgcatcagccagggcgccgggtggtccctccgggagaccgcctgcctgggcaaggcctacgcgcagatgtggagcctgatgtacttccaccgccgcgacctccggctggcctccaacgccatctgcagcgccgtgccggtccactgggtgcccacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccgtacctcggcaagcgcgaggaccagtggtgcgggtccctgatcggcctgacgagccgggcgacctgggcccagaacatccccaccgccatccagcaggtccgcagcctcatcgggaacgaggagttcctggactacatgccctccatgaagcggttccgcaaggaggaggagagcgagggcgccatctggtga

SEQ ID NO: 9910 - RNA, 9873 nt, synthetic construct
  misc_feature 1..9873: note = derived and/or modified CDS sequence (opt1) from DENV-3__FJ898445__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggagcgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggccgtgatcttcacgctgctgatgctcgtgacccccagcatgaccatgcggtgcgtcggggtgggcaaccgcgacttcgtggagggcctgtccggggccacctgggtcgacgtggtgctggagcacggcgggtgcgtcacgaccatggccaagaacaagcccaccctcgacatcgagctgcagaagaccgaggcgacgcagctggccaccctccggaagctgtgcatcgagggcaagatcaccaacatcaccacggacagccgctgccccacccagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcgagcaccaccgaggccatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgcgaagaagcaggaggtggtcgtgctggggtcccaggagggcgccatgcacacggccctcaccggggccaccgagatccagaacagcggcgggacctccatcttcgccggccacctgaagtgccggctgaagatggacaagctcgagctgaagggcatgagctacgcgatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcccacaacggccgcctgatcaccgccaaccccgtcgtgaccaagcgggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccgcggcgcccggcgcatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccggagcaccacccgcatggagaacctgctgtggaagcagatcgccaacgagctcaactacatcctgtgggagaacaacatcaagctgaccgtggtggtcggggacatcatcggcgtgctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgcgtcccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatggagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaactaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcggggaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatgacggtcgccgccatgggcgtgccgcccctcccgctgttcatcttcagcctcaaggacaccctgaagcgccggtcctggcccctgaacgagggggtgatggccgtcggcctcgtgagcatcctggcgtccagcctgctccgcaacgacgtgcccatggccggccccctggtcgccgggggcctgctcatcgcctgctacgtgatcaccgggacctccgccgacctgacggtggagaaggcggccgacgtcacctgggaggaggaggccgagcagaccggcgtgagccacaacctgatgatcaccgtggacgacgacgggaccatgcggatcaaggacgacgagacggagaacatcctcaccgtcctgctgaagaccgccctcctgatcgtgtccggcatcttcccgtacagcatccccgccaccctgctcgtgtggcacacgtggcagaagcagacccagcgctccggcgtcctgtgggacgtgcccagcccgcccgagacccagaaggcggagctggaggagggggtgtaccggatcaagcagcagggcatcttcgggaagacccaggtcggcgtgggggtgcagaaggagggcgtcttccacacgatgtggcacgtgacccgcggcgccgtgctcacctacaacgggaagcggctggagcccaactgggcctccgtcaagaaggacctgatcagctacggcgggggctggcgcctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgggagggcaaggtggtggggctgtacggcaacggggtcgtgaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtccgcgaggccatcaagcggcgcctccggaccctgatcctggcccccacccgcgtggtggccgccgagatggaggaggcgctcaaggggctgcccatccggtaccagacgaccgccaccaagtccgagcacaccggccgcgagatcgtcgacctgatgtgccacgccacgttcaccatgcggctcctgagccccgtgcgcgtgccgaactacaacctgatcatcatggacgaggcccacttcaccgaccccgcctccatcgcggcccgggggtacatcagcacccgcgtcggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtgtggttcgtgcccagcatcaaggccggcaacgacatcgccaactgcctccgcaagaacgggaagaaggtcatccagctgtcccggaagaccttcgacaccgagtaccagaagaccaagctgaacgactgggacttcgtggtgacgaccgacatcagcgagatgggcgccaacttcaaggccgaccgcgtcatcgacccgcggcgctgcctcaagcccgtgatcctgaccgacggccccgagcgggtgatcctggcggggcccatgccggtcaccgccgcctccgccgcccagcgccggggccgcgtggggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtctggctggcctacaaggtggccagcgagggcatcaagtacaccgaccggaagtggtgcttcgacgggcagcgcaacaaccagatcctggaggagaacatggacgtcgagatctggacgaaggagggcgagaagaagaagctccggccccgctggctggacgcccgcacctactccgacccgctggccctcaaggagttcaaggacttcgcggccggccgcaagagcatcgccctggacctggtgaccgagatcgggcgcgtgcccacccacctcgcccaccggacgcgcaacgccctggacaacctggtcatgctccacacctccgagcacggcgggaaggcgtaccggcacgccgtggaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcgggatcctcaccctggccgccatcatcgcggccaacgagatgggcatgctggagacgaccaagcgggacctcggcatgagcaaggagccgggggtggcctcccccaccagctacctggacgtggacctgcaccccgcctccgcgtggaccctctacgccgtcgccacgaccgtgatcacccccatgctgcgccacaccatcgagaacagcacggccaacgtgtccctggccgcgatcgccaaccaggccgtcgtgctcatgggcctggacaaggggtggccgatcagcaagatggacctgggcgtgcccctcctggccctggggtgctactcccaggtcaaccccctcaccctgaccgccgcggtgctgctcctgatcacccactacgccatcatcggccccggcctgcaggccaaggccacgcgggaggcccagaagcgcaccgcggccgggatcatgaagaacccgaccgtggacggcatcatgaccatcgacctcgaccccgtcatctacgacagcaagttcgagaagcagctgggccaggtgatgctgctcgtgctgtgcgccgtccagctgctcctgatgcggacgtcctgggccctgtgcgaggcgctcaccctggccaccggccccatcaccacgctgtgggagggcagccccgggaagttctggaacaccaccatcgccgtgtccatggccaacatcttccgcggcagctacctcgccggggcgggcctggccttctccatcatgaagtccgtggggaccggcaagcggggcaccgggtcccagggcgagacgctgggggagaagtggaagaagaagctcaaccagctgagccgcaaggagttcgacctgtacaagaagtccggcatcaccgaggtcgaccggaccgaggccaaggaggggctcaagcgcggcgagatcacccaccacgccgtgtcccggggcagcgccaagctgcagtggttcgtggagcgcaacatggtcatcccggaggggcgggtgatcgacctgggctgcgggcgcggcgggtggtcctactactgcgcgggcctcaagaaggtgacggaggtccggggctacaccaagggcgggcccgggcacgaggagcccgtgcccatgagcacctacggctggaacatcgtgaagctgatgtccgggaaggacgtcttctacctgccgcccgagaagtgcgacaccctcctgtgcgacatcggcgagagctcccccagccccacggtggaggagtcccgcaccatccgcgtgctgaagatggtcgagccgtggctgaagaacaaccagttctgcatcaaggtgctcaacccctacatgcccaccgtgatcgagcacctggagcggctgcagcgcaagcacggcgggatgctcgtccggaaccccctgagccgcaactccacccacgagatgtactggatcagcaacggcacggggaacatcgtggcctccgtgaacatggtcagccggctgctcctgaaccgcttcaccatgacccaccggcgcccgaccatcgagaaggacgtggacctgggcgccggcacgcggcacgtgaacgccgagcccgagacccccaacatggacgtcatcggggagcgcatcaagcggatcaaggaggagcacaactccacctggcactacgacgacgagaacccgtacaagacctgggcctaccacggcagctacgaggtgaaggcgacggggtccgccagctccatgatcaacggcgtggtcaagctcctgaccaagccctgggacgtggtccccatggtgatccagatggccatgaccgacaccacgcccttcgggcagcagcgcgtgttcaaggagaaggtcgacacccggaccccgcgcagcatgcccggcacccggcgcgtgatgggcatcacggccgagtggctgtggcggaccctcgggcgcaacaagaagccccggctgtgcacccgcgaggagttcacccgcaaggtgcggacgaacgcggccatgggcgccgtcttcaccgaggagaaccagtgggacagcgccaaggccgcggtggaggacgaggacttctggaagctggtggaccgcgagcgggagctccacaagctggggaagtgcggctcctgcgtctacaacatgatggggaagcgcgagaagaagctgggcgagttcggcaaggccaaggggagccgggccatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccgggggcgcgatgtacgccgacgacaccgccgggtgggacacccggatcacggaggacgacctgcacaacgaggagaagatcacccagcagatggacccggagcaccgccagctggccaacgccatcttcaagctcacctaccagaacaaggtggtcaaggtgcagcggcccacccccaccggcacggtgatggacatcatctcccgcaaggaccagcggggcagcgggcaggtcggcacctacgggctgaacaccttcaccaacatggaggcgcagctgatccgccagatggagggcgagggggtgctctccaaggccgacctggagaacccccacctccccgagaagaagatcacgcagtggctcgagaccaagggcgtggagcggctgaagcgcatggccatcagcggcgacgactgcgtcgtgaagcccatcgacgaccggttcgccaacgccctgctcgcgctgaacgacatggggaaggtgcgcaaggacatcccccagtggcagccctccaagggctggcacgactggcagcaggtcccgttctgcagccaccacttccacgagctgatcatgaaggacgggcggaagctcgtggtgccctgccgcccccaggacgagctgatcggccgggcccgcatctcccagggggccggctggagcctgcgcgagaccgcctgcctcggcaaggcgtacgcccagatgtggtccctgatgtacttccaccggcgcgacctgcggctcgccagcaacgccatctgctccgccgtccccgtgcactgggtgccgaccagccgcacgacctggtccatccacgcgcaccaccagtggatgaccaccgaggacatgctgacggtctggaaccgggtgtggatcgaggacaacccctggatggaggacaagacccccgtgaccacctgggagaacgtcccctacctggggaagcgcgaggaccagtggtgcggcagcctcatcgggctgacgagccgggccacctgggcccagaacatcccgaccgccatccagcaggtccgctccctgatcggcaacgaggagttcctcgactacatgcccagcatgaagcggttccgcaaggaggaggagtccgagggggccatctggtga

SEQ ID NO: 9911 - RNA, 9873 nt, synthetic construct
  misc_feature 1..9873: note = derived and/or modified CDS sequence (opt1) from DENV-3__GQ868571__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtgggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcggggaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatgaccgtcgccgccatgggcgtgccgcccctcccgctgttcatcttcagcctcaaggacacgctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacgtcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgcggccggccgcaagagcatcgccctggacctggtgaccgagatcgggcgggtgcccacccacctcgcccaccgcacccggaacgccctggacaacctggtcatgctccacacgtccgagcacggcgggaaggcgtaccgccacgccgtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcatgctggagaccacgaagcgcgacctcggcatgagcaaggagccgggggtggtgtcccccaccagctacctggacgtcgacctgcaccccgcctccgcctggaccctctacgcggtggccaccacggtgatcacccccatgctgcggcacaccatcgagaacagcaccgccaacgtctccctggccgccatcgcgaaccaggccgtggtgctcatgggcctggacaaggggtggccgatcagcaagatggacctgggcgtccccctcctggccctggggtgctactcccaggtgaaccccctcacgctgaccgccgccgtgctgctcctgatcacccactacgcgatcatcggccccggcctgcaggccaaggccacccgcgaggcccagaagcggacggccgcggggatcatgaagaacccgaccgtcgacggcatcatgaccatcgacctcgaccccgtgatctacgacagcaagttcgagaagcagctgggccaggtgatgctgctcgtcctgtgcgccgtgcagctgctcctgatgcgcacctcctgggccctgtgcgaggccctcacgctggcgaccggccccatcaccaccctgtgggagggcagccccgggaagttctggaacacgaccatcgccgtgtccatggccaacatcttccggggcagctacctcgccggggccggcctggcgttctccatcatgaagtccgtcgggaccggcaagcgcggcaccgggtcccagggcgagaccctgggggagaagtggaagaagaagctcaaccagctgagccggaaggagttcgacctgtacaagaagtccggcatcacggaggtggaccgcaccgaggccaaggaggggctcaagcggggcgagatcacccaccacgccgtgtcccgcggcagcgccaagctgcagtggttcgtcgagcggaacatggtgatcccggaggggcgcgtgatcgacctgggctgcgggcggggcgggtggtcctactactgcgccggcctcaagaaggtcaccgaggtgcgcggctacacgaagggcgggcccgggcacgaggagcccgtgcccatgagcacctacggctggaacatcgtcaagctgatgtccgggaaggacgtgttctacctgccgcccgagaagtgcgacaccctcctgtgcgacatcggcgagagctcccccagccccaccgtggaggagtcccggacgatccgcgtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgagccggaactccacccacgagatgtactggatcagcaacggcaccgggaacatcgtggcgtccgtcaacatggtgagccgcctgctcctgaaccggttcacgatgacccaccgccggccgaccatcgagaaggacgtggacctgggcgccggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggccaccgggtccgcgagctccatgatcaacggcgtcgtgaagctcctgacgaagccctgggacgtcgtgcccatggtgacccagatggccatgaccgacaccacgcccttcgggcagcagcgggtcttcaaggagaaggtggacacccgcaccccgcggagcatgcccggcacccgccgggtgatgggcatcacggccgagtggctgtggcgcaccctcgggcggaacaagaagccccgcctgtgcacccgggaggagttcaccaagaaggtccgcacgaacgccgcgatgggcgccgtgttcaccgaggagaaccagtgggacagcgccaaggccgccgtggaggacgaggacttctggaagctggtcgaccgcgagcgggagctccacaagctggggaagtgcggctcctgcgtgtacaacatgatggggaagcgcgagaagaagctgggcgagttcggcaaggcgaaggggagccgggccatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccgggggcgccatgtacgcggacgacaccgccgggtgggacacccggatcacggaggacgacctgcacaacgaggagaagatcacccagcagatggacccggagcaccgccagctggccaacgccatcttcaagctcacctaccagaacaaggtcgtgaaggtgcagcggcccacccccaccggcacggtcatggacatcatctcccgcaaggaccagcggggcagcggccaggtgggcacctacgggctgaacaccttcaccaacatggaggcccagctgatccgccagatggagggcgagggggtgctctccaaggcggacctggagaacccccacctccccgagaagaagatcacgcagtggctggagaccaagggcgtcgagcggctgaagcgcatggccatcagcggcgacgactgcgtggtgaagcccatcgacgaccggttcgccaacgccctgctcgccctgaacgacatggggaaggtccgcaaggacatcccccagtggcagccctccaagggctggcacgactggcagcaggtcccgttctgcagccaccacttccacgagctgatcatgaaggacgggcggaagctcgtggtcccctgccgcccccaggacgagctgatcggccgggcgcgcatctcccagggggccggctggagcctgcgggagaccgcctgcctcggcaaggcctacgcgcagatgtggtccctgatgtacttccaccgccgcgacctgcggctcgccagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctggggaagcgcgaggaccagtggtgcggcagcctcatcgggctgacgagccgggcgacctgggcccagaacatcccgaccgccatccagcaggtccgctccctgatcggcaacgaggagttcctcgactacatgcccagcatgaagcggttccgcaaggaggaggagtccgagggggccatctggtga

SEQ ID NO: 9912 - RNA, 9873 nt, synthetic construct
  misc_feature 1..9873: note = derived and/or modified CDS sequence (opt1) from DENV-3__GU131951__SS-prME
  source 1..9873: mol_type = other RNA
accagcctgtgcctcatgatgatcctgcccgcggccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatgagcaagaacaagcccaccctcgacatcgagctgcagaagaccgaggccacccagctggccacgctccggaagctgtgcatcgagggcaagatcaccaacatcaccaccgactcccgctgccccacgcagggcgaggcggtgctgccggaggagcaggaccagaactacgtctgcaagcacacctacgtggaccgggggtggggcaacgggtgcggcctcttcgggaagggcagcctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggcctccaccaccgaggccatcctgcccgagtacggcaccctggggctcgagtgcagcccgcgcaccggcctggacttcaacgagatgatcctgctcacgatgaagaacaaggcgtggatggtgcaccggcagtggttcttcgacctgcccctgccctggacctccggcgccaccaccgagacgcccacctggaaccgcaaggagctcctggtgaccttcaagaacgcccacgccaagaagcaggaggtcgtggtgctggggagccaggagggcgccatgcacaccgcgctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgtcccgtgcaagatccccttcagcaccgaggacgggcagggcaaggcccacaacggccgcctgatcacggcgaaccccgtggtgaccaagaaggaggagcccgtcaacatcgaggccgagccgcccttcggggagtccaacatcgtgatcggcatcggggacaacgccctgaagatcaactggtacaagaagggcagctccatcgggaagatgttcgaggccaccgcgcggggcgcccgccggatggccatcctgggcgacaccgcctgggacttcgggagcgtgggcggggtcctcaactccctgggcaagatggtgcaccagatcttcgggagcgcctacacggcgctgttctccggcgtgagctgggtcatgaagatcggcatcggggtgctcctgacctggatcggcctgaactccaagaacaccagcatgtccttcagctgcatcgccatcgggatcatcaccctctacctgggcgccgtggtccaggccgacatggggtgcgtgatcaactggaagggcaaggagctgaagtgcggctccgggatcttcgtgacgaacgaggtccacacctggaccgagcagtacaagttccaggccgacagccccaagcgcctcgcgaccgccatcgccggcgcctgggagaacggggtgtgcggcatccgctccacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtacagctggaagacctgggggaaggcgaagatcgtcaccgccgagacccagaactccagcttcatcatcgacggccccaacacgcccgagtgcccctccgccagccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagtcccagaagaacgggagctggaagctggagaaggcctccctgatcgaggtgaagacctgcacgtggcccaagtcccacaccctctggtccaacggcgtgctggagagcgacatgatcatccccaagtccctggcggggcccatcagccagcacaactaccggccgggctaccacacccagaccgccgggccctggcacctcggcaagctggagctggacttcaactactgcgagggcacgaccgtcgtgatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccggggaggtggacaacttcacgatgggcgtcctgtgcctcgccatcctgttcgaggaggtgatgcgggggaagttcggcaagaagcacatgatcgccggggtgttcttcaccttcgtcctgctcctgagcggccagatcacctggcgcgacatggcgcacaccctgatcatgatcggctccaacgccagcgaccggatggggatgggcgtgacgtacctcgccctgatcgccaccttcaagatccagcccttcctggccctcgggttcttcctgcgcaagctgaccagccgggagaacctcctgctgggcgtgggcctcgcgatggccaccacgctgcagctgcccgaggacatcgagcagatggccaacgggatcgccctcggcctgatggcgctgaagctcatcacccagttcgagacctaccagctgtggaccgccctgatctccctcacgtgcagcaacaccatcttcaccctgaccgtcgcctggcgcacggccaccctgatcctcgccggggtgtccctgctgccggtctgccagagctccagcatgcggaagaccgactggctccccatgaccgtggcggccatgggcgtgccgcccctcccgctgttcatcttctccctcaaggacacgctgaagcgccgcagctggcccctgaacgagggggtcatggccgtgggcctcgtgtccatcctggccagctccctgctccggaacgacgtccccatggccggccccctggtggccggcgggctgctcatcgcctgctacgtgatcaccgggaccagcgccgacctgaccgtcgagaaggccgccgacgtgacgtgggaggaggaggcggagcagaccggggtgtcccacaacctgatgatcaccgtcgacgacgacgggaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggcgtgctgtgggacgtgcccagcccgcccgaggcccagaaggccgagctggaggagggggtctaccgcatcaagcagcagggcatcttcgggaagacccaggtgggcgtgggggtccagaaggagggcgtgttccacaccatgtggcacgtgacccggggcgcggtcctcacgtacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagaccatgcccggcaccttccagaccacgaccggggagatcggcgcgatcgccctggacttcaagcccgggaccagcggctcccccatcatcaaccgcgagggcaaggtggtcgggctgtacggcaacggggtggtgaccaagaacggcgggtacgtcagcggcatcgcccagacgaacgccgagccggacggccccacccccgagctggaggaggagatgttcaagaagcggaacctcaccatcatggacctgcaccccgggtccggcaagacccgcaagtacctgccggccatcgtgcgggaggcgatcaagcgccggctccgcacgctgatcctggcccccacccgggtggtcgccgccgagatggaggaggccctcaaggggctgcccatccgctaccagaccaccgcgaccaagagcgagcacaccggccgggagatcgtggacctgatgtgccacgccaccttcaccatgcgcctcctgtcccccgtgcgggtcccgaactacaacctgatcatcatggacgaggcccacttcacggaccccgccagcatcgccgcgcgcgggtacatctccacccgggtgggcatgggcgaggccgccgccatcttcatgaccgcgacgccgcccgggacggccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctccggaagaacgggaagaaggtgatccagctgagccgcaagaccttcgacacggagtaccagaagaccaagctgaacgactgggacttcgtggtcaccaccgacatctccgagatgggcgccaacttcaaggccgaccgggtgatcgacccgcgccggtgcctcaagcccgtgatcctgacggacggccccgagcgcgtcatcctggccgggcccatgccggtgaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagacgttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggccctcaaggagttcaaggacttcgccgcgggccgcaagtccatcgccctggacctggtgacggagatcgggcgggtccccagccacctcgcccaccgcacccggaacgccctggacaacctggtgatgctccacaccagcgagcacggcgggaaggcctaccgccacgcggtggaggagctgcccgagaccatggagacgctgctcctgctgggcctcatgatcctgctgaccgggggcgccatgctgttcctgatctccggcaaggggatcggcaagaccagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcacgctggccgccatcatcgccgcgaacgagatgggcctgctcgagaccaccaagcgcgacctgggcatgagcaaggagccgggggtggtctcccccaccagctacctggacgtggacctccaccccgcctccgcctggacgctgtacgccgtggcgaccaccgtcatcacccccatgctgcggcacacgatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtgatctacgacagcaagttcgagaagcagctggggcaggtcatgctcctggtgctgtgcgcggtgcagctcctgctgatgcgcacctcctgggccctctgcgaggccctgaccctggccaccggccccatcacgaccctctgggagggcagccccgggaagttctggaacaccaccatcgcggtctccatggccaacatcttccggggcagctacctggccggggccggcctggccttctccatcatgaagtccgtggggacgggcaagcgcggcaccgggagccagggcgagaccctcggggagaagtggaagaagaagctgaaccagctgtcccggaaggagttcgacctctacaagaagtccggcatcaccgaggtggaccgcaccgaggcgaaggaggggctgaagcggggcgagatcacgcaccacgccgtctcccgcggcagcgccaagctgcagtggttcgtggagcggaacatggtgaccccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccatcgtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacgcacgagatgtactggatcagcaacggcaccgggaacatcgtcgcctccgtgaacatggtgagccgcctcctgctgaaccggttcaccatgacccaccgccggccgacgatcgagaaggacgtcgacctcggcgcgggcacccgccacgtgaacgccgagcccgagacccccaacatggacgtgatcggggagcggatcaagcgcatcaaggaggagcacaactccacctggcactacgacgacgagaacccgtacaagacgtgggcctaccacggcagctacgaggtcaaggccaccgggtccgccagcagcatgatcaacggcgtggtcaagctgctgaccaagccctgggacgtggtgcccatggtcacccagatggcgatgacggacaccacccccttcgggcagcagcgggtgttcaaggagaaggtggacacccgcacgccgcggtccatgcccggcacccgccgggtcatgggcatcaccgccgagtggctctggcgcaccctggggcggaacaagaagccccgcctgtgcacgcgggaggagttcaccaagaaggtgcgcaccaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacgtaccagaacaaggtggtgaaggtccagcggcccacccccaccggcaccgtgatggacatcatctcccgcaaggaccagcggggcagcggccaggtgggcacctacgggctgaacacgttcaccaacatggaggcccagctcatccgccagatggagggcgagggggtcctgtccaaggccgacctggagaacccccacctcccggagaagaagatcacccagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagacggcctgcctgggcaaggcctacgcccagatgtggtccctgatgtacttccaccgccgcgacctccggctggcgagcaacgccatctgctccgccgtgcccgtccactgggtgccgaccagccgcaccacctggagcatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggctccctgatcgggctgaccagccgggccacctgggcgcagaacatcccgacggccatccagcaggtccgctccctcatcggcaacgaggagttcctggactacatgcccagcatgaagcggttccgcaaggaggaggagtccgagggggccatctggtga

SEQ ID NO: 9913 - RNA, 9873 nt, synthetic construct
  misc_feature 1..9873: note = derived and/or modified CDS sequence (opt1) from DENV-3__GQ868572__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggtccacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatctcccgcaaggaccagcggggcagcggccaggtgggcacctacgggctgaacaccttcaccaacatggaggcccagctcatccgccagatggagggcgagggggtcctgtccaaggccgacctggagaacccccacctcccggagaagaagatcacgcagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcacgacctggtccatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 9914 - RNA, 9873 nt, synthetic construct
  misc_feature 1..9873: note = derived and/or modified CDS sequence (opt1) from DENV-3__GQ868573__SS-prME
  source 1..9873: mol_type = other RNA
accagcttctgcctcatgatgatcctccccgcggccctggcgttccacctgaccagccgggacggggagccccggatgatcgtggggaagaacgagcggggcaagagcctcctgttcaagaccgccagcgggatcaacatgtgcaccctgatcgccatggacctcggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctggcgccccacgtgggcatggggctcgacacccgcacccagacctggatgagcgccgagggcgcctggcgccaggtggagaaggtcgagacgtgggccctgcgccacccggggttcaccatcctggccctcttcctggcccactacatcggcacctccctgacccagaaggccgtgatcttcatcctcctgatgctggtgacgcccagcatgaccatgcggtgcgtcggggtgggcaaccgcgacttcgtggagggcctctccggggccacctgggtcgacgtggtgctggagcacggcgggtgcgtcaccacgatggccaagaacaagcccaccctggacatcgagctccagaagaccgaggcgacccagctggccacgctgcggaagctctgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctgttcgggaagggctccctcgtgacctgcgccaagttccagtgcctggagcccatcgagggcaaggtggtccagtacgagaacctgaagtacaccgtgatcatcacggtgcacaccggggaccagcaccaggtcggcaacgagacccagggggtgaccgccgagatcacgccccaggcgagcaccaccgaggccatcctccccgagtacggcaccctggggctggagtgctccccgcgcaccggcctcgacttcaacgagatgatcctgctgacgatgaagaacaaggcctggatggtccaccggcagtggttcttcgacctccccctgccctggaccagcggcgccaccaccgagacgcccacctggaaccgcaaggagctgctcgtgaccttcaagaacgcccacgcgaagaagcaggaggtggtcgtgctggggtcccaggagggcgccatgcacaccgccctgacgggggccaccgagatccagaacagcggcgggacctccatcttcgccggccacctcaagtgccggctgaagatggacaagctggagctcaagggcatgagctacgcgatgtgcaccaacacgttcgtgctgaagaaggaggtctccgagacccagcacgggaccatcctgatcaaggtggagtacaagggcgaggacgtgccgtgcaagatccccttcagcaccgaggacgggcagggcaaggcccacaacggccgcctcatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctgaacagcctcggcaagatggtccaccagatcttcgggtccgcctacacggccctgttcagcggcgtgtcctgggtgatgaagatcggcatcggggtcctgctcacctggatcggcctgaacagcaagaacacctccatgagcttctcctgcatcgccatcgggatcatcaccctgtacctcggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctggccaccgccatcgccggcgcgtgggagaacggggtctgcggcatccgcagcacgacccggatggagaacctcctgtggaagcagatcgccaacgagctgaactacatcctctgggagaacaacatcaagctgaccgtggtggtcggggacatcatcggcgtgctggagcagggcaagcgcaccctcacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctgaagctccgcgaggtctacacccagctgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggccgggcccatctcccagcacaactaccggccgggctaccacacccagaccgccgggccctggcacctgggcaagctcgagctggacttcaactactgcgagggcacgaccgtggtcatcaccgagaactgcgggacccgcggccccagcctgcggacgaccaccgtgtccgggaagctcatccacgagtggtgctgccgcagctgcaccctgcccccgctgcggtacatgggcgaggacgggtgctggtacggcatggagatccgccccatctccgagaaggaggagaacatggtcaagagcctcgtctccgccggcagcggggaggtggacaacttcacgatgggcgtgctgtgcctggcgatcctcttcgaggaggtcatgcgggggaagttcggcaagaagcacatgatcgccggggtgttcttcaccttcgtgctgctgctctccggccagatcacctggcgcgacatggcccacaccctgatcatgatcggcagcaacgcctccgaccggatggggatgggcgtcacgtacctggccctcatcgcgaccttcaagatccagcccttcctggccctggggttcttcctccgcaagctgaccagccgggagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatcagcctgacgtgctccaacaccatcttcaccctcaccgtggcctggcgcacggcgaccctgatcctggccggggtcagcctcctgccggtgtgccagtccagctccatgcggaagaccgactggctgcccatgaccgtcgccgccatgggcctgccgcccctcccgctgttcatcttcagcctcaaggacacgctgaagcgccgctcctggcccctgaacgagggggtgatggccgtgggcctcgtcagcatcctggcgtccagcctgctccggaacgacgtgcccatggccggccccctggtggccgggggcctgctcatcgcctgctacgtcatcaccgggacctccgccgacctgaccgtggagaaggcggccgacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggcggagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcctccgtgaagaaggacctgatcagctacggcgggggctggcggctctccgcccagtggcagaagggggaggaggtccaggtgatcgcggtggagcccggcaagaaccccaagaacttccagaccatgcccggcaccttccagacgaccaccggggagatcggcgccatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtgcgggaggccatcaagcgccggctccgcaccctgatcctggcccccacccgggtcgtggccgccgagatggaggaggcgctcaaggggctgcccatccgctaccagaccacggccaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgcggcccgcgggtacatcagcacccgggtgggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtctggttcgtgcccagcatcaaggccggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgcggccggccgcaagagcatcgccctggacctggtcaccgagatcgggcgggtgcccacccacctcgcccaccgcacccggaacgccctggacaacctggtgatgctccacacgtccgagcacggcgggaaggcgtaccgccacgccgtcgaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcgtccgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgagcaaggagccgggggtcgtgtcccccaccagctacctggacgtggacctccaccccgcctccgcctggaccctgtacgcggtcgccaccacggtgatcacccccatgctgcggcacaccatcgagaacagcaccgccaacgtgtccctcgccgccatcgcgaaccaggccgtcgtgctgatgggcctggacaaggggtggccgatcagcaagatggacctcggcgtgcccctgctggccctcgggtgctactcccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgacagcaagttcgagaagcagctgggccaggtgatgctcctggtgctgtgcgccgtccagctcctgctgatgcgcacctcctgggccctctgcgaggccctgacgctggcgaccggccccatcaccaccctctgggagggcagccccgggaagttctggaacacgaccatcgccgtgtccatggccaacatcttccggggcagctacctggccggggccggcctggcgttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtcgaccgcaccgaggccaaggaggggctgaagcggggcgagatcacccaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccggacgatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcaccgggaacatcgtggcgtccgtgaacatggtcagccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaactccacctggcactacgacgacgagaacccgtacaagacctgggcctaccacggcagctacgaggtgaaggccaccgggtccgcgagctccatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgggaggagttcaccaagaaggtgcgcacgaacgccgcgatgggcgccgtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatctcccgcaaggaccagcggggcagcgggcaggtcggcacctacgggctgaacaccttcaccaacatggaggcccagctcatccgccagatggagggcgagggggtgctgtccaaggcggacctggagaacccccacctcccggagaagaagatcacgcagtggctggagaccaagggcgtggagcggctgaagcgcatggccatcagcggcgacgactgcgtcgtgaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtccccgtgcactgggtgccgaccagccgcacgacctggtccatccacgcccaccaccagtggatgaccaccgaggacatgctgacggtctggaaccgggtgtggatcgaggacaacccctggatggaggacaagacccccgtgaccacctgggagaacgtcccctacctcgggaagcgcgaggaccagtggtgcggcagcctgatcgggctgacgagccgggcgacctgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 9915 - RNA, 9873 nt, synthetic construct
  misc_feature 1..9873: note = derived and/or modified CDS sequence (opt1) from DENV-3__GQ868574__SS-prME
  source 1..9873: mol_type = other RNA
acctccctgtgcctcatgatgatcctgcccgccgccctggcgttccacctcacctcccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcagctactgcgagggcacgaccgtggtcatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtcagcgccggctccggggaggtggacaacttcacgatgggcgtgctgtgcctcgcgatcctgttcgaggaggtcatgcgggggaagttcggcaagaagcacatgatcgccggggtgttcttcaccttcgtgctgctcctgagcggccagatcacctggcgcgacatggcccacaccctgatcatgatcggctccaacgccagcgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatctccctcacgtgcagcaacaccatcttcaccctgaccgtggcctggcgcacggcgaccctgatcctcgccggggtctccctgctgccggtgtgccagagctccagcatgcggaagaccgactggctccccatgaccgtcgccgccatgggcgtgccgcccctcccgctgttcatcttctccctcaaggacacgctgaagcgccgcagctggcccctgaacgagggggtgatggccgtcggcctcgtgtccatcctggcgagctccctgctccggaacgacgtgcccatggccggccccctggtcgccgggggcctgctcatcgcctgctacgtgatcaccgggaccagcgccgacctgaccgtggagaaggcggccgacgtcacgtgggaggaggaggccgagcagaccggcgtgtcccacaacctgatgatcaccgtggacgacgacgggaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggccagcgtcaagaaggacctgatctcctacggcgggggctggcggctcagcgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggctcccccatcatcaaccgcgagggcaaggtggtggggctgtacggcaacggggtcgtgacgaagaacggcgggtacgtgagcggcatcgcccagaccaacgccgagccggacggccccacccccgagctggaggaggagatgttcaagaagcggaacctcaccatcatggacctgcaccccgggtccggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagagcgagcacaccggccgggagatcgtcgacctgatgtgccacgccaccttcacgatgcgcctcctgtcccccgtgcgggtgccgaactacaacctgatcatcatggacgaggcccacttcaccgaccccgccagcatcgcggcccgcgggtacatctccacccgggtcggcatgggcgaggccgccgcgatcttcatgaccgccacgccgcccgggaccgccgacgccttcccgcagagcaacgcccccatccaggacgaggagcgcgacatccccgagcgctcctggaacagcggcaacgagtggatcaccgacttcgcggggaagaccgtgtggttcgtgccctccatcaaggccggcaacgacatcgccaactgcctccggaagaacgggaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacggccccgagcgcgtgatcctggcggggcccatgccggtcaccgccgccagcgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagagccggaagaccttcgtggagctgatgcgccgcggggacctccccgtctggctggcccacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtacagcgacccgctggccctcaaggagttcaaggacttcgcggccggccgcaagtccatcgccctggacctggtgaccgagatcgggcgggtgcccacccacctcgcccaccgcacccggaacgccctggacaacctggtcatgctccacacgagcgagcacggcgggaaggcgtaccgccacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcatgctggagaccacgaagcgcgacctcggcatgtccaaggagccgggggtggccagccccacctcctacctggacgtggacctgcaccccgccagcgcgtggaccctctacgccgtcgccaccacggtgatcacccccatgctgcggcacaccatcgagaactccaccgccaacgtgagcctggccgcgatcgccaaccaggccgtcgtgctcatgggcctggacaaggggtggccgatctccaagatggacctgggcgtgcccctcctggccctggggtgctacagccaggtcaaccccctcacgctgaccgccgcggtgctgctcctgatcacccactacgccatcatcggccccggcctgcaggccaaggccacccgcgaggcccagaagcggacggcggccgggatcatgaagaacccgaccgtggacggcatcatgaccatcgacctcgaccccgtcatctacgactccaagttcgagaagcagctgggccaggtgatgctgctcgtgctgtgcgccgtccagctgctcctgatgcgcaccagctgggccctgtgcgaggcgctcacgctggccaccggccccatcaccaccctgtgggagggctcccccgggaagttctggaacacgaccatcgccgtgagcatggccaacatcttccggggctcctacctcgccggggcgggcctggccttcagcatcatgaagtccgtggggaccggcaagcgcggcaccgggagccagggcgagaccctgggggagaagtggaagaagaagctcaaccagctgagccggaaggagttcgacctgtacaagaagtccggcatcacggaggtcgaccgcaccgaggccaaggaggggctcaagcggggcgagatcacccaccacgccgtgagccgcggctccgccaagctgcagtggttcgtggagcggaacatggtcatcccggaggggcgcgtgatcgacctgggctgcgggcggggcgggtggagctactactgcgcgggcctcaagaaggtgaccgaggtccgcggctacacgaagggcgggcccgggcacgaggagcccgtgcccatgtccacctacggctggaacatcgtgaagctgatgagcgggaaggacgtcttctacctgccgcccgagaagtgcgacaccctcctgtgcgacatcggcgagtccagcccctcccccaccgtggaggagagccggacgatccgcgtgctgaagatggtcgagccgtggctgaagaacaaccagttctgcatcaaggtgctcaacccctacatgcccaccgtgatcgagcacctggagcgcctgcagcggaagcacggcgggatgctcgtccgcaaccccctgtcccggaacagcacccacgagatgtactggatctccaacggcaccgggaacatcgtggccagcgtgaacatggtctcccgcctgctcctgaaccggttcacgatgacccaccgccggccgaccatcgagaaggacgtggacctgggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggcgaccgggagcgcctccagcatgatcaacggcgtggtcaagctcctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctgtggcgcaccctcgggcggaacaagaagccccgcctgtgcacccgggaggagttcaccaagaaggtgcgcacgaacgcggccatgggcgccgtcttcaccgaggagaaccagtgggactccgccaaggccgcggtggaggacgaggacttctggaagctggtggaccgcgagcgggagctccacaagctggggaagtgcggcagctgcgtctacaacatgatggggaagcgcgagaagaagctgggcgagttcggcaaggccaaggggtcccgggccatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgcgatgtacgccgacgacaccgccgggtgggacacccggatcacggaggacgacctgcacaacgaggagaagatcacccagcagatggacccggagcaccgccagctggccaacgccatcttcaagctcacctaccagaacaaggtggtcaaggtgcagcggcccacccccaccggcacggtgatggacatcatcagccgcaaggaccagcggggctccgggcaggtcggcacctacgggctgaacaccttcaccaacatggaggcgcagctgatccgccagatggagggcgagggggtgctcagcaaggccgacctggagaacccccacctccccgagaagaagatcacgcagtggctggagaccaagggcgtggagcggctgaagcgcatggccatctccggcgacgactgcgtcgtgaagcccatcgacgaccggttcgccaacgccctgctcgcgctgaacgacatggggaaggtgcgcaaggacatcccccagtggcagcccagcaagggctggcacgactggcagcaggtcccgttctgctcccaccacttccacgagctgatcatgaaggacgggcggaagctcgtggtgccctgccgcccccaggacgagctgatcggccgggcccgcatcagccagggggccggctggtccctgcgggagaccgcctgcctcggcaaggcgtacgcccagatgtggagcctgatgtacttccaccgccgcgacctgcggctcgcctccaacgccatctgcagcgccgtccccgtgcactgggtgccgacctcccgcacgacctggagcatccacgcgcaccaccagtggatgaccaccgaggacatgctgacggtctggaaccgggtgtggatcgaggacaacccctggatggaggacaagacccccgtgaccacctgggagaacgtcccctacctggggaagcgcgaggaccagtggtgcggcagcctcatcgggctgacgtcccgggccacctgggcccagaacatcccgaccgccatccagcaggtccgcagcctgatcggcaacgaggagttcctcgactacatgccctccatgaagcggttccgcaaggaggaggagagcgagggggccatctggtga

SEQ ID NO: 9916 - RNA, 9873 nt, synthetic construct
  misc_feature 1..9873: note = derived and/or modified CDS sequence (opt1) from DENV-3__GQ868575__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacttcagcttcatcatcgacggccccaacacgcccgagtgcccctccgcgagccgggcctggaacgtctgggaggtggaggactacgggttcggcgtgttcaccaccaacatctggctcaagctgcgcgaggtctacacccagctgtgcgaccaccggctcatgtccgccgccgtgaaggacgagcgcgccgtgcacgcggacatgggctactggatcgagagccagaagaacgggagctggaagctggagaaggcctccctgatcgaggtcaagacctgcacgtggcccaagagccacaccctctggtccaacggcgtgctggagagcgacatgatcatccccaagtccctggccgggcccatcagccagcacaactaccggccgggctaccacacccagaccgccgggccctggcacctcggcaagctggagctggacttcaactactgcgagggcacgaccgtggtcatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtcagcgccggctccggggaggtggacaacttcacgatgggcgtgctgtgcctcgcgatcctgttcgaggaggtcatgcgggggaagttcggcaagaagcacatgatcgccggggtgttcttcaccttcgtgctgctcctgagcggccagatcacctggcgcgacatggcccacaccctgatcatgatcggctccaacgccagcgacaagatggggatgggcgtcacgtacctcgccctgatcgcgaccttcaagatccagcccttcctggccctcgggttcttcctgcggaagctgacctcccgcgagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgcagcaacaccatcttcaccctgaccgtggcctggcggacggcgaccctgatcctcgccggggtctccctgctgccggtgtgccagagctccagcatgcgcaagaccgactggctccccatgaccgtcgccgccatgggcgtgccgcccctcccgctgttcatcttcgggctcaaggacacgctgaagcggcgctcctggcccctgaacgagggcgtgatggccgtcggcctcgtgagcatcctggcgtccagcctgctccgcaacgacgtgcccatggccgggcccctggtcgccggcgggctgctcatcgcctgctacgtgatcaccggcacctccgccgacctgaccgtggagaaggcggccgacgtcacgtgggaggaggaggccgagcagaccggggtgagccacaacctgatgatcaccgtggacgacgacggcaccatgcggatcaaggacgacgagaccgagaacatcctcacggtcctgctgaagaccgccctcctgatcgtgtccggcatcttcccgtacagcatccccgccaccctgctcgtgtggcacacctggcagaagcagacgcagcgctccggggtcctgtgggacgtgcccagcccgcccgagacccagaaggcggagctggaggagggcgtgtaccggatcaagcagcaggggatcttcggcaagacccaggtcggggtgggcgtgcagaaggagggcgtcttccacaccatgtggcacgtgacgcgcggggccgtgctcacctacaacggcaagcggctggagcccaactgggcctccgtcaagaaggacctgatcagctacgggggcgggtggcgcctctccgcccagtggcagaagggcgaggaggtccaggtgatcgcggtcgagcccggcaagaaccccaagaacttccagaccatgcccgggaccttccagacgaccaccggcgagatcggggccatcgccctggacttcaagcccggcaccagcggctcccccatcatcaaccgggaggggaaggtggtgggcctgtacgggaacggcgtcgtgacgaagaacgggggctacgtgagcggcatcgcccagaccaacgccgagccggacgggcccacccccgagctggaggaggagatgttcaagaagcgcaacctcaccatcatggacctgcaccccggcagcgggaagacgcggaagtacctgccggcgatcgtccgcgaggccatcaagcggcgcctccggaccctgatcctggcccccacccgcgtggtggccgccgagatggaggaggcgctcaagggcctgcccatccggtaccagaccacggccaccaagtccgagcacaccgggcgcgagatcgtcgacctgatgtgccacgccaccttcacgatgcggctcctgagccccgtgcgcgtgccgaactacaacctgatcatcatggacgaggcccacttcaccgaccccgcctccatcgcggcccggggctacatcagcacccgcgtcggcatgggggaggccgccgcgatcttcatgaccgccacgccgcccggcaccgccgacgccttcccgcagtccaacgcccccatccaggacgaggagcgggacatccccgagcgcagctggaactccgggaacgagtggatcaccgacttcgcgggcaagaccgtgtggttcgtgcccagcatcaaggccgggaacgacatcgccaactgcctccgcaagaacggcaagaaggtcatccagctgtcccggaagacgttcgacaccgagtaccagaagaccaagctgaacgactgggacttcgtggtgaccacggacatcagcgagatgggcgccaacttcaaggccgaccgcgtcatcgacccgcggcgctgcctcaagcccgtgatcctgaccgacgggcccgagcgggtgatcctggcgggccccatgccggtcaccgccgcctccgccgcccagcgccgggggcgcgtgggccggaacccccagaaggagaacgaccagtacatcttcaccgggcagcccctcaacaacgacgaggaccacgcgcactggaccgaggccaagatgctgctggacaacatcaacacgcccgagggcatcatcccggccctcttcgagcccgagcgcgagaagtccgccgcgatcgacggcgagtaccggctgaagggggagtcccgcaagaccttcgtggagctgatgcggcgcggcgacctccccgtctggctggcccacaaggtggccagcgaggggatcaagtacaccgaccggaagtggtgcttcgacggccagcgcaacaaccagatcctggaggagaacatggacgtcgagatctggaccaaggagggcgagaagaagaagctccggccccgctggctggacgcccggacgtactccgacccgctggccctcaaggagttcaaggacttcgcggccgggcgcaagagcatcgccctggacctggtgaccgagatcggccgcgtgcccacccacctcgcccaccggacccgcaacgccctggacaacctggtcatgctccacacgtccgagcacgggggcaaggcgtaccggcacgccgtggaggagctgcccgagaccatggagaccctgctcctgctggggctcatgatcctgctgaccggcggcgccatgctgttcctgatcagcgggaagggcatcgggaagacgtccatcggcctgatctgcgtgatcgccagcagcgggatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcggcatcctcaccctggccgccatcatcgcggccaacgagatgggcctgctcgagaccacgaagcgggacctggggatgagccgcgagccgggcgtggtgtcccccaccagctacctggacgtcgacctccaccccgcctccgcctggaccctgtacgcggtggccaccacggtgatcacccccatgctgcggcacaccatcgagaacagcaccgccaacgtctccctcgccgccatcgcgaaccaggccgtggtgctgatggggctggacaagggctggccgatcagcaagatggacctcggggtccccctgctggccctcggctgctactcccaggtgaaccccctgacgctgaccgccgccgtgctcctgctgatcacccactacgcgatcatcggccccgggctccaggccaaggccacccgcgaggcccagaagcggacggccgcgggcatcatgaagaacccgaccgtcgacgggatcatgaccatcgacctggaccccgtgatctacgacagcaagttcgagaagcagctgggccaggtgatgctcctggtcctgtgcgccgtgcagctcctgctgatgcgcacctcctgggccctctgcgaggccctgacgctggcgaccggccccatcaccaccctctgggaggggagccccggcaagttctggaacacgaccatcgccgtgtccatggccaacatcttccgggggagctacctggccggcgccgggctggcgttctccatcatgaagtccgtcggcaccggcaagcgcgggaccggctcccagggggagaccctcggcgagaagtggaagaagaagctgaaccagctgagccggaaggagttcgacctctacaagaagtccgggatcacggaggtggaccgcaccgaggccaaggagggcctgaagcggggcgagatcacccaccacgccgtgagccgcgggagcgccaagctgcagtggttcgtcgagcggaacatggtgatcccggagggccgcgtgatcgacctcgggtgcggccgcgggggctggtcctactactgcgccggcctgaagaaggtcaccgaggtgcgcgggtacacgaagggcgggcccggccacgaggagcccgtgcccatgagcacctacgggtggaacatcgtcaagctgatgtccggcaaggacgtgttctacctcccgcccgagaagtgcgacaccctgctgtgcgacatcggcgagagctcccccagccccaccgtggaggagtcccggacgatccgcgtcctgaagatggtggagccgtggctcaagaacaaccagttctgcatcaaggtgctgaacccctacatgcccaccgtcatcgagcacctggagcgcctccagcggaagcacgggggcatgctggtgcgcaaccccctgagccggaactccacccacgagatgtactggatcagcaacgggaccggcaacatcgtggcgtccgtcaacatggtgagccgcctcctgctgaaccggttcacgatgacccaccgccggccgaccatcgagaaggacgtggacctcggcgccgggacccgccacgtcaacgccgagcccgagatccccaacatggacgtgatcggcgagcggatcaagcgcatcaaggaggagcacaactccacgtggcactacgacgacgagaacccgtacaagacctgggcctaccacgggagctacgaggtgaaggccaccggctccgcgagctccatgatcaacggggtcgtgaagctgctgaccaagccctgggacgtcgtgcccatggtgacgcagatggccatgaccgacaccacccccttcggccagcagcgggtcttcaaggagaaggtggacacgcgcaccccgcggagcatgcccggcacccgccgggtgatggggatcaccgccgagtggctctggcgcacgctgggccggaacaagaagccccgcctgtgcacccgggaggagttcaccaagaaggtccgcaccaacgccgcgatgggggccgtgttcacggaggagaaccagtgggactccgccaaggccgccgtggaggacgaggacttctggaagctcgtcgaccgcgagcgggagctgcacaagctgggcaagtgcgggagctgcgtgtacaacatgatgggcaagcgcgagaagaagctcggcgagttcgggaaggcgaagggcagccgggccatctggtacatgtggctgggggcccgctacctggagttcgaggccctcggcttcctgaacgaggaccactggttctcccgggagaacagctactccggggtggagggcgagggcctgcacaagctcgggtacatcctgcgcgacatcagcaagatccccggcggggccatgtacgcggacgacaccgccggctgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatctcccgcaaggaccagcgggggagcggccaggtggggacgtacggcctgaacaccttcaccaacatggaggcccagctcatccgccagatggagggggagggcgtgctgtccaaggcggacctggagaacccccacctcccggagaagaagatcacccagtggctggagacgaagggcgtcgagcggctgaagcgcatggccatcagcggggacgactgcgtggtgaagcccatcgacgaccggttcgccaacgccctcctggccctgaacgacatgggcaaggtccgcaaggacatcccccagtggcagccctccaaggggtggcacgactggcagcaggtcccgttctgcagccaccacttccacgagctcatcatgaaggacggccggaagctggtggtcccctgccgcccccaggacgagctgatcgggcgggcgcgcatctcccagggcgccggctggagcctccgggagaccgcctgcctggggaaggcctacgcgcagatgtggtccctgatgtacttccaccgccgcgacctccggctggccagcaacgccatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgacctcccgggcgacgtgggcccagaacatcccgaccgccatccagcaggtccgcagcctcatcgggaacgaggagttcctggactacatgcccagcatgaagcggttccgcaaggaggaggagtccgagggcgccatctggtga

SEQ ID NO: 9917 - RNA, 9873 nt, synthetic construct
  misc_feature 1..9873: note = derived and/or modified CDS sequence (opt1) from DENV-3__GU131953__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgggacaagcggagcgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacgccgtgctggagtccgacatgatcatccccaagagcctggccggccccatctcccagcacaactaccggccggggtaccacacccagaccgccggcccctggcacctcgggaagctggagctggacttcaactactgcgagggcacgaccgtggtcatcaccgagaactgcggcacccgcgggcccagcctccggacgaccaccgtgtccggcaagctgatccacgagtggtgctgccgcagctgcaccctgcccccgctccggtacatgggggaggacggctgctggtacgggatggagatccgccccatctccgagaaggaggagaacatggtcaagagcctggtctccgcgggcagcggcgaggtggacaacttcacgatgggggtgctgtgcctcgccatcctgttcgaggaggtcatgcggggcaagttcgggaagaagcacatgatcgccggcgtgttcttcaccttcgtgctgctcctgtccgggcagatcacctggcgcgacatggcccacaccctgatcatgatcggcagcaacgcctccgaccggatgggcatgggggtcacgtacctcgcgctgatcgccaccttcaagatccagcccttcctggccctcggcttcttcctgcgcaagctgaccagccgggagaacctcctgctgggggtgggcctcgccatggcgaccacgctgcagctgcccgaggacatcgagcagatggccaacggcatcgccctcgggctgatggccctgaagctcatcacccagttcgagacctaccagctgtggaccgccctgatcagcctcacgtgctccaacaccatcttcaccctgaccgtggcgtggcgcacggccaccctgatcctcgccggcgtcagcctgctgccggtgtgccagtccagctccatgcggaagaccgactggctccccatgaccgtcgccgccatgggggtgccgcccctcccgctgttcatcttcagcctcaaggacacgctgaagcgccgctcctggcccctgaacgagggcgtgatggcggtcgggctcgtgagcatcctggcctccagcctgctccggaacgacgtgcccatggccggccccctggtcgccggcgggctgctcatcgcctgctacgtgatcaccggcacctccgcggacctgaccgtggagaaggccgccgacgtcacgtgggaggaggaggccgagcagaccggggtgagccacaacctgatgatcaccgtggacgacgacggcaccatgcgcatcaaggacgacgagaccgagaacatcctcacggtcctgctgaagaccgccctcctgatcgtgtccgggatcttcccgtacagcatccccgcgaccctgctcgtgtggcacacctggcagaagcagacgcagcggtccggcgtcctgtgggacgtgcccagcccgcccgagacccagaaggccgagctggaggagggcgtgtaccgcatcaagcagcaggggatcttcggcaagacccaggtcggggtgggcgtgcagaaggagggggtcttccacaccatgtggcacgtgacgcggggcgccgtgctcacctacaacggcaagcgcctggagcccaactgggcctccgtcaagaaggacctgatcagctacgggggcgggtggcggctctccgcgcagtggcagaagggcgaggaggtccaggtgatcgccgtcgagcccgggaagaaccccaagaacttccagaccatgcccggcaccttccagacgaccaccggcgagatcggggccatcgccctggacttcaagcccggcaccagcgggagccccatcatcaaccgcgagggcaaggtggtgggcctgtacgggaacggcgtcgtgacgaagaacgggggctacgtgtccgggatcgcccagaccaacgcggagccggacggccccacccccgagctggaggaggagatgttcaagaagcggaacctcaccatcatggacctgcaccccggcagcgggaagacgcgcaagtacctgccggccatcgtccgggaggccatcaagcgccggctccgcaccctgatcctggcccccacccgggtggtggccgcggagatggaggaggccctcaagggcctgcccatccgctaccagaccacggccaccaagtccgagcacaccgggcgggagatcgtcgacctgatgtgccacgccaccttcacgatgcgcctcctgagccccgtgcgggtgccgaactacaacctgatcatcatggacgaggcccacttcaccgaccccgcgtccatcgccgcccgcggctacatcagcacccgggtcgggatgggcgaggccgcggccatcttcatgaccgccacgccgcccggcaccgccgacgccttcccgcagtccaacgcgcccatccaggacgaggagcgcgacatccccgagcgcagctggaactccgggaacgagtggatcaccgacttcgccggcaagaccgtgtggttcgtgcccagcatcaaggccgggaacgacatcgccaactgcctccggaagaacggcaagaaggtcatccagctgtcccgcaagacgttcgacaccgagtaccagaagaccaagctgaacgactgggacttcgtggtgaccacggacatcagcgagatgggggccaacttcaaggcggaccgggtcatcgacccgcgccggtgcctcaagcccgtgatcctgaccgacggccccgagcgcgtgatcctggccggccccatgccggtcaccgccgcctccgccgcgcagcggcgcgggcgggtgggccgcaacccccagaaggagaacgaccagtacatcttcaccgggcagcccctcaacaacgacgaggaccacgcccactggaccgaggccaagatgctgctggacaacatcaacacgcccgagggcatcatcccggccctcttcgagcccgagcgggagaagtccgcggccatcgacggggagtaccgcctgaagggcgagtcccggaagaccttcgtggagctgatgcgccggggcgacctccccgtctggctggcccacaaggtggccagcgaggggatcaagtacaccgaccgcaagtggtgcttcgacggccagcggaacaaccagatcctggaggagaacatggacgtcgagatctggaccaaggagggggagaagaagaagctccgcccccggtggctggacgcccgcacgtactccgacccgctggcgctcaaggagttcaaggacttcgccgccggccgcaagagcatcgccctggacctggtgaccgagatcggccgggtgcccacccacctcgcccaccgcacccggaacgcgctggacaacctggtcatgctccacacgtccgagcacgggggcaaggcctaccgccacgccgtggaggagctgcccgagaccatggagaccctgctcctgctggggctcatgatcctgctgaccggcggggccatgctgttcctgatcagcggcaagggcatcgggaagacgagcatcggcctgatctgcgtgatcgcctccagcgggatgctctggatggcggagatcccgctgcagtggatcgcctccgccatcgtcctggagttcttcatgatggtgctcctgatccccgagcccgagaagcagcggacgccccaggacaaccagctggcctacgtggtcatcggcatcctcaccctggccgcgatcatcgccgccaacgagatggggctgctcgagaccacgaagcgcgacctgggcatgagcaaggagccgggcgtggtgtcccccaccagctacctggacgtcgacctccaccccgcctccgcgtggaccctgtacgccgtggccaccacggtgatcacccccatgctgcggcacaccatcgagaacagcaccgccaacgtctccctcgccgcgatcgccaaccaggccgtggtgctgatggggctggacaagggctggccgatcagcaagatggacctcggggtccccctgctggccctcggctgctactcccaggtgaaccccctgacgctgaccgccgcggtgctcctgctgatcacccactacgccatcatcgggcccggcctccaggccaaggccacccgcgaggcccagaagcggacggcggccggcatcatgaagaacccgaccgtcgacgggatcatgaccatcgacctggaccccgtgatctacgacagcaagttcgagaagcagctgggccaggtgatgctcctggtcctgtgcgccgtgcagctcctgctgatgcgcacctcctgggccctctgcgaggcgctgacgctggccaccgggcccatcaccaccctctgggagggcagccccggcaagttctggaacacgaccatcgccgtgtccatggccaacatcttccgggggagctacctggccggcgcggggctggccttctccatcatgaagtccgtcggcaccgggaagcgcggcaccggctcccagggggagaccctcggcgagaagtggaagaagaagctgaaccagctgagccggaaggagttcgacctctacaagaagtccgggatcacggaggtggaccgcaccgaggccaaggagggcctgaagcgcggggagatcacccaccacgccgtgtcccgcggcagcgccaagctgcagtggttcgtcgagcggaacatggtgatcccggagggccgcgtgatcgacctcgggtgcggccgcgggggctggtcctactactgcgcggggctgaagaaggtcaccgaggtgcgcggctacacgaagggcgggcccggccacgaggagcccgtgcccatgagcacctacgggtggaacatcgtcaagctgatgtccggcaaggacgtgttctacctcccgcccgagaagtgcgacaccctgctgtgcgacatcggggagagctcccccagccccaccgtggaggagtcccggacgatccgcgtcctgaagatggtggagccgtggctcaagaacaaccagttctgcatcaaggtgctgaacccctacatgcccaccgtcatcgagcacctggagcgcctccagcggaagcacggcggcatgctggtgcgcaaccccctgagccggaactccacccacgagatgtactggatcagcaacgggaccggcaacatcgtggcctccgtcaacatggtgagccgcctcctgctgaaccggttcacgatgacccaccgccggccgaccatcgagaaggacgtggacctcggggccggcacccgccacgtcaacgccgagcccgagacgcccaacatggacgtgatcggcgagcggatcaagcgcatcaaggaggagcacaactccacctggcactacgacgacgagaacccgtacaagacctgggcctaccacgggagctacgaggtgaaggcgaccggctccgccagctccatgatcaacggggtcgtgaagctgctgacgaagccctgggacgtcgtgcccatggtgacccagatggccatgaccgacaccacgcccttcggccagcagcgggtcttcaaggagaaggtggacacccgcaccccgcggagcatgcccgggacccgccgggtgatggagatcacggccgagtggctctggcgcaccctgggccggaacaagaagccccgcctgtgcacccgggaggagttcaccaagaaggtccgcacgaacgcggccatgggcgccgtgttcaccgaggagaaccagtgggacagcgccaaggccgcggtggaggacgaggacttctggaagctcgtcgaccgcgagcgggagctgcacaagctggggaagtgcggctcctgcgtgtacaacatgatggggaagcgcgagaagaagctcggcgagttcgggaaggccaagggcagccgggccatctggtacatgtggctgggcgcccgctacctggagttcgaggccctcgggttcctgaacgaggaccactggttctcccgggagaacagctactccggcgtggagggggagggcctgcacaagctcgggtacatcctgcgcgacatcagcaagatccccggcggcgcgatgtacgccgacgacaccgccgggtgggacacccggatcacggaggacgacctgcacaacgaggagaagatcacccagcagatggacccggagcaccgcctcctggccaacgccatcttcaagctgacctaccagaacaaggtcgtgaaggtgcagcggcccacccccaccggcacggtcatggacatcatctcccgcaaggaccagcgggggagcggccaggtgggcacctacgggctcaacaccttcaccaacatggaggcgcagctgatccgccagatggagggcgagggggtgctgtccaaggccgacctcgagaacccccacctgagcgagaagaaggtcacgcagtggctggagaccaagggcgtggagcggctcaagcgcatggccatctccggggacgactgcgtggtcaagccgatcgacgaccggttcgccaacgccctgctggcgctcaacgacatgggcaaggtgcgcaaggacatcccccagtggcagcccagcaagggctggcacgactggcagcaggtccccttctgctcccaccacttccacgagctgatcatgaaggacgggcggaagctggtcgtgccgtgccgcccccaggacgagctcatcggccgggcccgcatcagccagggggccggctggtccctgcgggagaccgcctgcctggggaaggcgtacgcccagatgtggagcctcatgtacttccaccgccgcgacctgcggctggcctccaacgccatctgcagcgccgtgcccgtccactgggtgcccacctcccgcacgacctggagcatccacgcgcaccaccagtggatgaccaccgaggacatgctcacggtgtggaaccgggtctggatcgaggacaacccgtggatggaggacaagacccccgtgaccacctgggagaacgtgccctacctgggcaagcgcgaggaccagtggtgcggcagcctgatcgggctcacgtcccgggccacctgggcccagaacatccccaccgccatccagcaggtccgcagcctgatcggcaacgaggagttcctggactacatgccgtccatgaagcggttccgcaaggaggaggagagcgagggggccatctggtga

SEQ ID NO: 9918 - RNA, 9873 nt, synthetic construct
  misc_feature 1..9873: note = derived and/or modified CDS sequence (opt1) from DENV-3__GQ868577__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaagatcgtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgtacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgcccacccacctcgcccaccgcacccggaacgccctggacaacctggtcatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccacgaagcgcgacctgggcatgagcaaggagccgggggtggtgtcccccaccagctacctggacgtcgacctccaccccgcctccgcctggaccctgtacgccgtggcgaccacggtgatcacccccatgctgcggcacaccatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgacgctgaccgccgccgtgctcctgctgatcacccactacgccatcatcggccccggcctccaggcgaaggccacccgcgaggcccagaagcggacggccgccgggatcatgaagaacccgaccgtcgacggcatcatgaccatcgacctggaccccgtgatctacgacagcaagttcgagaagcagctgggccaggtgatgctcctggtcctgtgcgcggtgcagctcctgctgatgcgcacctcctgggccctctgcgaggccctgacgctggccaccggccccatcaccaccctctgggagggcagccccgggaagttctggaacacgaccatcgcggtgtccatggccaacatcttccggggcagctacctggccggggccggcctggccttctccatcatgaagtccgtcgggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcaccgaggtgcgcggctacacgaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcaccgggaacatcgtggcctccgtcaacatggtgagccgcctcctgctgaaccggttcacgatgacccaccgccggccgaccatcgagaaggacgtggacctcggcgcgggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggccaccgggtccgccagctccatgatcaacggcgtcgtgaagctgctgacgaagccctgggacgtcgtgcccatggtgacccagatggcgatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgggaggagttcaccaagaaggtccgcacgaacgccgccatgggcgcggtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatctcccgcaaggaccagcggggcagcggccaggtgggcacctacgggctgaacaccttcaccaacatggaggcccagctcatccgccagatggagggcgagggggtgctgtccaaggccgacctggagaacccccacctcccggagaagaagatcgcgcagtggctggagacgaagggcgtcgagcggctgaagcgcatggccatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggagaacaagacgcccgtcaccacctgggagaacgtgccctacctcgggaagcgcgaggaccagtggtgcggcagcctgatcgggctgaccagccgggcgacgtgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 9919 - RNA, 9873 nt, synthetic construct
  misc_feature 1..9873: note = derived and/or modified CDS sequence (opt1) from DENV-3__GU131954__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgtacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgtcatgctgttcctgatcagcggcaaggggatcggcaagacgagcatcgggctgatctgcgtgatcgcctccagcggcatgctctggatggccgagatcccgctgcagtggatcgcctccgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccacgaagcgcgacctgggcatgaccaaggagccgggggcggtcagccccacctcctacctggacgtggacctccaccccgccagcgcctggaccctgtacgccgtggcgacgaccgtcatcacccccatgctgcggcacaccatcgagaactccacggccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgaccgccgccgtcctcctgctgatcacccactacgccatcatcggccccggcctccaggcgaaggccacgcgcgaggcccagaagcggaccgccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcacgagctgggccctctgcgaggccctgaccctggccaccggccccatcaccacgctctgggagggctcccccgggaagttctggaacaccaccatcgcggtcagcatggccaacatcttccggggctcctacctggccggggccggcctggccttcagcatcatgaagtccgtggggaccggcaagcgcggcaccgggagccagggcgagacgctcggggagaagtggaagaagaagctgaaccagctgtcccggaaggagttcgacctctacaagaagtccggcatcaccgaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgacggaggtgcgcggctacaccaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccacggtcgaggagagccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcacggggaacatcgtcgccagcgtgaacatggtgtcccgcctcctgctgaaccggttcaccatgacccaccgccggccgaccatcgagaaggacgtcgacctcggcgcgggcacgcgccacgtgaacgccgagcccgagacccccaacatggacgtgatcggggagcggatcaagcgcatcaaggaggagcacaacagcacctggcactacgacgacgagaacccgtacaagacctgggcctaccacggctcctacgaggtcaaggccacggggagcgcctccagcatgatcaacggcgtggtcaagctgctgaccaagccctgggacgtggtgcccatggtcacccagatggcgatgaccgacacgacccccttcgggcagcagcgggtgttcaaggagaaggtggacacccgcaccccgcggtccatgcccggcacgcgccgggtcatgggcatcaccgccgagtggctctggcgcaccctggggcggaacaagaagccccgcctgtgcacccgggaggagttcacgaagaaggtgcgcaccaacgccgccatgggcgcggtgttcaccgaggagaaccagtgggacagcgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtggtgaaggtccagcggcccacccccacgggcaccgtgatggacatcatcagccgcaaggaccagcggggctccggccaggtgggcacctacgggctgaacaccttcacgaacatggaggcccagctcatccgccagatggagggcgagggggtcctgagcaaggccgacctggagaacccccacctcccggagaagaaggtgacccagtggctggagaccaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtccccgtgcactgggtgccgacgtcccgcaccacctggagcatccacgcccaccaccagtggatgaccacggaggacatgctgaccgtctggaaccgggtgtggatcgaggacaacccctggatggaggacaagacccccgtgaccacgtgggagaacgtcccctacctcgggaagcgcgaggaccagtggtgcggctccctgatcgggctgaccagccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 9920 - RNA, 9873 nt, synthetic construct
  misc_feature 1..9873: note = derived and/or modified CDS sequence (opt1) from DENV-3__GQ868578__SS-prME
  source 1..9873: mol_type = other RNA
accagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagtacgagaacctcaagtacaccgtgatcatcacggtccacaccggggaccagcaccaggtgggcaacgagacccagggggtcaccgccgagatcacgccccaggcctccaccaccgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaaccgcaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgtcccctgcaagatcccgttcagcaccgaggacgggcagggcaaggcgcacaacggccgcctgatcacggccaaccccgtggtgaccaagaaggaggagcccgtcaacatcgaggccgagcccccgttcggggagtccaacatcgtgatcggcatcggggacaacgccctgaagatcaactggtacaagaagggcagctccatcgggaagatgttcgaggcgaccgcccggggcgcccgccggatggccatcctgggcgacaccgcctgggacttcgggagcgtgggcggggtcctcaactccctgggcaagatggtgcaccagatcttcgggagcgcgtacacggccctgttctccggcgtgagctgggtcatgaagatcggcatcggggtgctcctgacctggatcggcctgaactccaagaacaccagcatgtccttcagctgcatcgccatcgggatcatcaccctctacctgggcgccgtggtccaggccgacatggggtgcgtgatcaactggaagggcaaggagctgaagtgcggctccgggatcttcgtgacgaacgaggtccacacctggaccgagcagtacaagttccaggcggacagccccaagcgcctcgccaccgccatcgccggcgcctgggagaacggggtgtgcggcatccgctccacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagcccatggagctgaagtacagctggaagacctgggggaaggccaagatcgtcaccgccgagacccagaactccagcttcatcatcgacggcccgaacacgcccgagtgcccctccgccagccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagtcccagaagaacgggagctggaagctggagaaggcgtccctgatcgaggtgaagacctgcaagtggcccaagagccacacgctctggtccaacggcgtgctggagagcgacatgatcatcccgaagtccctggccgggcccatcagccagcacaactaccggcccggctaccacacccagaccgccgggccgtggcacctcggcaagctggagctggacttcaactactgcgagggcaccacggtcgtgatcaccgagaactgcgggacccgcggcccctccctccggaccacgaccgtgagcgggaagctgatccacgagtggtgctgccgctcctgcaccctgccccccctccggtacatgggcgaggacgggtgctggtacggcatggagatccgcccgaccagcgagaaggaggagaacatggtcaagtccctggtgagcgccggctccggggaggtggacaacttcacgatgggcgtcctgtgcctcgccatcctgttcgaggaggtgatgcgggggaagttcggcaagaagcacatgatcgcgggggtgctgttcaccttcgtcctcctgctgagcggccagatcacctggcgcgacatggcccacaccctcatcatgatcggctccaacgccagcgaccggatggggatgggcgtgacgtacctggccctgatcgccaccttcaagatccagcccttcctcgcgctggggttcttcctgcgcaagctcaccagccgggagaacctgctgctcggcgtgggcctggccatggccaccacgctgcagctccccgaggacatcgagcagatggccaacgggatcgcgctgggcctgatggccctcaagctgatcacccagttcgagacctaccagctgtggaccgccctcatctccctgacgtgcagcaacaccatcttcaccctgaccgtcgcctggcgcacggccaccctcatcctggcgggggtgtccctgctccccgtctgccagagctccagcatgcggaagaccgactggctgccgatgaccgtggccgccatgggcgtgccccccctgcccctcttcatcttctccctgaaggacacgctgaagcgccgcagctggccgctcaacgagggggtcatggccgtgggcctggtgtccatcctggccagctccctcctgcggaacgacgtccccatggcgggccccctggtggccgggggcctcctgatcgcctgctacgtgatcaccgggaccagcgccgacctgaccgtcgagaaggccgcggacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgccctgctgatcgtgagcggcatcttcccctactccatcccggccaccctcctggtctggcacacctggcagaagcagacgcagcggagcggcgtgctgtgggacgtgccctccccccccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgcggtcctgacctacaacgggaagcgcctggagccgaactgggccagcgtgaagaaggacctcatctcctacggcgggggctggcggctgagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagccggggaccagcggctcccccatcatcaaccgcgagggcaagatcgtggggctgtacggcaacggggtcgtgacgaagaacggcgggtacgtgagcggcatcgcccagaccaacgccgagcccgacggcccgacccccgagctcgaggaggagatgttcaagaagcggaacctgaccatcatggacctgcaccccgggtccggcaagacgcgcaagtacctccccgccatcgtccgggaggcgatcaagcgccggctgcgcaccctgatcctcgccccgacccgggtggtggccgccgagatggaggaggccctgaaggggctgcccatccgctaccagaccacggcgaccaagagcgagcacaccggccgggagatcgtcgacctcatgtgccacgccaccttcacgatgcgcctgctgtcccccgtgcgggtgcccaactacaacctcatcatcatggacgaggcccacttcaccgacccggccagcatcgccgcgcgcgggtacatctccacccgggtcggcatgggcgaggccgccgccatcttcatgaccgcgacgccccccgggaccgccgacgccttcccccagagcaacgccccgatccaggacgaggagcgcgacatccccgagcgctcctggaacagcggcaacgagtggatcaccgacttcgccgggaagaccgtgtggttcgtgccctccatcaaggcgggcaacgacatcgccaactgcctgcggaagaacgggaagaaggtcatccagctgagccgcaagacgttcgacaccgagtaccagaagaccaagctcaacgactgggacttcgtggtgaccacggacatctccgagatgggcgccaacttcaaggccgaccgggtcatcgacccccgccggtgcctgaagccggtgatcctgaccgacggccccgagcgcgtgatcctcgccgggcccatgcccgtcaccgcggccagcgccgcccagcggcgcggccgggtggggcgcaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgggagaagtccgccgccatcgacggcgagtaccgcctgaagggcgagagccggaagaccttcgtggagctcatgcgccggggggacctgcccgtctggctggcgtacaaggtggcctccgagggcatcaagtacaccgaccgcaagtggtgcttcgacgggcagcggaacaaccagatcctcgaggagaacatggacgtcgagatctggaccaaggagggcgagaagaagaagctgcgcccccggtggctggacgcccgcacgtacagcgaccccctcgccctgaaggagttcaaggacttcgccgcgggccgcaagtccatcgccctggacctcgtgaccgagatcgggcgggtgccgacccacctggcccaccgcacccggaacgccctggacaacctcgtcatgctgcacacgagcgagcacggcgggaaggcctaccgccacgcggtggaggagctgcccgagaccatggagaccctcctgctgctcggcctgatgatcctgctcaccgggggcgccatgctgttcctgatcagcggcaaggggatcggcaagacgtccatcgggctcatctgcgtgatcgccagctccggcatgctgtggatggccgagatccccctgcagtggatcgccagcgcgatcgtcctcgagttcttcatgatggtgctgctgatcccggagcccgagaagcagcggaccccccaggacaaccagctcgcctacgtggtcatcgggatcctgaccctggccgccatcatcgccgcgaacgagatgggcctcctggagaccacgaagcgcgacctgggcatgtccaaggagcccggggtggtgagcccgacctcctacctcgacgtcgacctgcaccccgccagcgcctggaccctgtacgccgtggcgaccacggtgatcacccccatgctccggcacaccatcgagaactccaccgccaacgtcagcctggccgccatcgccaaccaggcggtggtgctgatgggcctcgacaaggggtggcccatctccaagatggacctgggcgtcccgctgctcgccctggggtgctacagccaggtgaaccccctgacgctcaccgccgccgtgctgctgctcatcacccactacgccatcatcggccccggcctgcaggcgaaggccacccgcgaggcccagaagcggacggccgccgggatcatgaagaaccccaccgtcgacggcatcatgaccatcgacctggacccggtgatctacgactccaagttcgagaagcagctcgggcaggtgatgctgctggtcctctgcgcggtgcagctgctgctcatgcgcaccagctgggccctgtgcgaggccctgacgctcgccaccggccccatcaccaccctgtgggagggctcccccgggaagttctggaacacgaccatcgcggtgagcatggccaacatcttccggggctcctacctggccggggccggcctcgccttcagcatcatgaagtccgtcgggaccggcaagcgcggcaccgggagccagggcgagaccctgggggagaagtggaagaagaagctgaaccagctcagccggaaggagttcgacctgtacaagaagtccggcatcacggaggtggaccgcaccgaggcgaaggaggggctgaagcggggcgagatcacccaccacgccgtgagccgcggctccgccaagctccagtggttcgtcgagcggaacatggtgatccccgaggggcgcgtgatcgacctgggctgcgggcggggcgggtggagctactactgcgccggcctgaagaaggtcaccgaggtgcgcggctacacgaaggggggcccggggcacgaggagcccgtgcccatgtccacctacggctggaacatcgtcaagctcatgagcgggaaggacgtgttctacctgcccccggagaagtgcgacaccctgctgtgcgacatcggcgagtccagcccctcccccaccgtggaggagagccggacgatccgcgtcctcaagatggtggagccctggctgaagaacaaccagttctgcatcaaggtgctgaacccgtacatgcccaccgtcatcgagcacctcgagcgcctgcagcggaagcacggcgggatgctggtgcgcaaccccctctcccggaacagcacccacgagatgtactggatctccaacggcaccgggaacatcgtggccagcgtcaacatggtgtcccgcctgctgctcaaccggttcacgatgacccaccgccggcccaccatcgagaaggacgtggacctgggcgcgggcacccgccacgtcaacgccgagccggagacgcccaacatggacgtgatcggggagcggatcaagcgcatcaaggaggagcacaacagcacctggcactacgacgacgagaacccctacaagacctgggcctaccacggctcctacgaggtgaaggccaccgggagcgcctccagcatgatcaacggcgtcgtgaagctgctcacgaagccgtgggacgtcgtgcccatggtgacccagatggcgatgaccgacaccacgcccttcgggcagcagcgggtcttcaaggagaaggtggacacccgcaccccccggagcatgccgggcacccgccgggtgatgggcatcacggccgagtggctgtggcgcaccctggggcggaacaagaagccccgcctctgcacccgggaggagttcaccaagaaggtccgcacgaacgccgccatgggcgcggtgttcaccgaggagaaccagtgggactccgccaaggccgccgtggaggacgaggacttctggaagctggtcgaccgcgagcgggagctgcacaagctcgggaagtgcggcagctgcgtgtacaacatgatggggaagcgcgagaagaagctgggcgagttcggcaaggccaaggggtcccgggcgatctggtacatgtggctgggcgcccgctacctcgagttcgaggccctggggttcctgaacgaggaccactggttcagccgggagaactcctacagcggcgtggagggggagggcctccacaagctgggctacatcctgcgcgacatctccaagatccccgggggcgccatgtacgccgacgacaccgcggggtgggacacccggatcacggaggacgacctccacaacgaggagaagatcacccagcagatggaccccgagcaccgccagctggccaacgccatcttcaagctgacctaccagaacaaggtcgtgaaggtgcagcggccgacccccaccggcacggtcatggacatcatcagccgcaaggaccagcggggctccgggcaggtgggcacctacgggctcaacaccttcaccaacatggaggcccagctgatccgccagatggagggcgagggggtgctgagcaaggccgacctcgagaacccccacctgcccgagaagaagatcgcgcagtggctggagacgaagggcgtcgagcggctcaagcgcatggccatctccggcgacgactgcgtggtgaagccgatcgacgaccggttcgccaacgccctgctggccctcaacgacatggggaaggtccgcaaggacatcccccagtggcagcccagcaagggctggcacgactggcagcaggtgcccttctgctcccaccacttccacgagctgatcatgaaggacgggcggaagctggtggtcccgtgccgcccccaggacgagctcatcggccgggcgcgcatcagccagggggccggctggtccctgcgggagaccgcctgcctgggcaaggcctacgcgcagatgtggagcctcatgtacttccaccgccgcgacctgcggctggcctccaacgccatctgcagcgccgtgcccgtgcactgggtccccacctcccgcaccacgtggagcatccacgcccaccaccagtggatgaccaccgaggacatgctcaccgtgtggaaccgggtgtggatcgaggacaacccgtggatggaggacaagacgcccgtcaccacctgggagaacgtgccctacctggggaagcgcgaggaccagtggtgcggcagcctgatcgggctcacctcccgggcgacgtgggcccagaacatccccaccgccatccagcaggtgcgcagcctgatgggcaacgaggagttcctggactacatgccgtccatgaagcggttccgcaaggaggaggagagcgagggggccatctggtga

SEQ ID NO: 9921 - RNA, 9873 nt, synthetic construct
  misc_feature 1..9873: note = derived and/or modified CDS sequence (opt1) from DENV-3__FJ898457__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagcacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctggatcatgaagatcggcatcggggtgctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgcgatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtcggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtgatggcggtgggcctcgtcagcatcctggcctccagcctgctccggaacgacgtgcccatggccggccccctggtggccgggggcctgctcatcgcctgctacgtcatcacggggacctccgcggacctgaccgtggagaaggccgccgacatcacctgggaggaggaggccgagcagacgggcgtgagccacaacctgatgatcaccgtcgacgacgacgggaccatgcgcatcaaggacgacgagaccgagaacatcctcaccgtgctgctgaagacggccctcctgatcgtgtccggcatcttcccgtacagcatccccgcgaccctgctcgtctggcacacctggcagaagcagacccagcggtccggcgtgctgtgggacgtgcccagcccgcccgagacgcagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggcctccgtgaagaaggacctgatcagctacggcgggggctggcggctctccgcgcagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagacgaacgcggagccggacggccccacccccgagctggaggaggagatgttcaagaagcggaacctcaccatcatggacctgcaccccgggagcggcaagacccgcaagtacctgccggccatcgtgcgggaggccatcaagcgccggctccgcacgctgatcctggcccccacccgggtggtcgccgcggagatggaggaggccctcaaggggctgcccatccgctaccagaccaccgccacgaagtccgagcacaccggccgggagatcgtggacctgatgtgccacgccaccttcaccatgcgcctcctgagccccgtgcgggtcccgaactacaacctgatcatcatggacgaggcccacttcacggaccccgcgtccatcgccgcccgcgggtacatcagcacccgggtgggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaaggcggaccgggtgatcgacccgcgccggtgcctcaagcccgtgatcctgacggacggccccgagcgcgtcatcctggccgggcccatgccggtgaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtcgagctgatgcgccgcggggacctccccgtgtggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggcgctcaaggagttcaaggacttcgccgccggccgcaagagcatcgccctggacctggtgacggagatcgggcgggtcccctcccacctcgcccaccgcacccggaacgcgctggacaacctggtgatgctccacaccagcgagcacggcgggcgcgcctaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcgcacgccccaggacaaccagctggcctacgtcgtgatcgggatcctcacgctggccgcgatcatcgccgccaacgagatgggcctgctcgagaccaccaagcgggacctgggcatgtccaaggagccgggggtggtcagccccacctcctacctggacgtggacctccaccccgccagcgcgtggacgctgtacgccgtggccaccaccgtcatcacccccatgctgcgccacacgatcgagaactccaccgccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcggaccagctgggccctctgcgaggcgctgaccctggccaccggccccatcacgaccctctgggagggctcccccgggaagttctggaacaccaccatcgccgtcagcatggccaacatcttccgcggctcctacctggccggggcgggcctggccttcagcatcatgaagacggtggggaccggcaagcggggcaccgggtcccagggcgagaccctcggggagaagtggaagaagaagctgaaccagctgagccgcaaggagttcgacctctacaagaagtccggcatcaccgaggtggaccggacggaggccaaggaggggctgaagcgcggcgagatcacccaccacgccgtctcccggggcagcgccaagctgcagtggttcgtggagcgcaacatggtgatcccggaggggcgggtcatcgacctcggctgcgggcgcggcgggtggtcctactactgcgcgggcctgaagaaggtgaccgaggtgcggggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgagccgcaactccacccacgagatgtactggatcagcaacggcaccgggaacatcgtcgcctccgtgaacatggtgagccggctcctgctgaaccgcttcaccatgacgcaccggcgcccgaccatcgagaaggacgtcgacctcggcgccggcacccggcacgtgaacgccgagcccgagacccccaacatggacgtgatcggggagcgcatcaagcggatcaaggaggagcacaactccacgtggcactacgacgacgagaacccgtacaagacctgggcctaccacggcagctacgaggtcaaggcgaccgggtccgccagctccatgatcaacggcgtggtgaagctgctgaccaagccctgggacgtcgtgcccatggtcacgcagatggccatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccggctgtgcacccgcgaggagttcaccaagaaggtgcgcaccaacgcggccatgggcgccgtgttcacggaggagaaccagtgggacagcgccaaggccgcggtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgcgatgtacgccgacgacaccgccgggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatctcccggaaggaccagcgcggcagcggccaggtgggcacgtacgggctgaacaccttcaccaacatggaggcgcagctcatccggcagatggagggcgagggggtcctgtccaaggccgacctggagaacccccacctcccggagaagaagatcacccagtggctggagacgaagggcgtggagcgcctgaagcggatggccatcagcggcgacgactgcgtggtcaagcccatcgacgaccgcttcgccaacgccctcctggcgctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtgcccgtccactgggtgccgaccagccggaccacgtggtccatccacgcgcaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgaccagccgcgccacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 9922 - RNA, 9873 nt, synthetic construct
  misc_feature 1..9873: note = derived and/or modified CDS sequence (opt1) from DENV-3__KF955505__SS-prME
  source 1..9873: mol_type = other RNA
accagcctgtgcctcatgatgatcctgcccgccgccctggcgttccacctcaccagccggaacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcgcacggcgaccctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcgtgttcccgtacagcatccccgcgaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgcggagccggacggccccacccccgagctggaggaggagatgttcaagaagcggaacctcaccatcatggacctgcaccccgggagcggcaagacccgcaagtacctgccggccatcgtccgggaggccatcaagcgccggctccgcacgctgatcctggcccccacccgggtggtggccgcggagatggaggaggccctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcgtccatcgccgcccgcgggtacatcagcacccgggtcggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggcggaccgggtcatcgacccgcgccggtgcctcaagcccgtgatcctgacggacggccccgagcgcgtgatcctggccgggcccatgccggtcaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggcgctcaaggagttcaaggacttcgccgccggccgcaagagcatcgccctggacctggtgacggagatcgggcgggtgccctcccacctcgcccaccgcacccggaacgcgctggacaacctggtcatgctccacaccagcgagcacggcgggcgcgcctaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcgcacgccccaggacaaccagctggcctacgtggtcatcgggatcctcacgctggccgcgatcatcgccgccaacgagatgggcctgctcgagaccaccaagcgggacctgggcatgtccaaggagccgggggtggtgagccccacctcctacctggacgtcgacctccaccccgccagcgcgtggacgctgtacgccgtggccaccaccgtgatcacccccatgctgcgccacacgatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacgcactacgccatcatcggccccggcctccaggccaaggccacccgggaggcccagaagcgcaccgcggccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggcgctgaccctggccaccggccccatcacgaccctctgggagggctcccccgggaagttctggaacaccaccatcgccgtgagcatggccaacatcttccgcggctcctacctggccggggcgggcctggccttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagacgacccaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgccggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggcgaccgggagcgcctccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcccccgcgaggagttcaccaagaaggtccgcaccaacgcggccatgggcgccgtgttcaccgaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgccgaagctcggctacatcctgcgggacatctccaagatccccgggggcgcgatgtacgccgacgacacggccgggtgggacacccgcatcaccgaggacgacctgcacaacgaggagaagatcccccaccagatggaccccgagcacagccggctcgccaacgccatcttcaagctgacctaccagaacaaggtcgtgaaggtgcagcgcccgacgcccaccggcaccgtcatggacatcatctcccggaaggcgcagcgcggcagcggccaggtgggcacctacgggctgaacaccttcacgaacatggaggcccagctcatccggcagatggagggcgagggggtgctgtccaaggccgacctggagaacccccacctccccgagaagaagatcacccagtggctggagaccaagggcgtcgagcgcctgaagcggatggccatcaccggcgacgactgcgtggtgaagccgatcgacgaccgcttcgccaacgcgctcctggccctgaacgacatggggaaggtccggaaggacatcccccagtggcagcccagcaagggctggcacgactggcagcaggtccccttctgctcccaccacttccacgagctcatcatgaaggacgggcgcaagctggtggtcccgtgccggccccaggacgagctgatcggccgcgcccggatcagccagggggccggctggtccctccgcgagacggcgtgcctgggcaaggcctacgcccagatgtggagcctgatgtacttccaccgccgggacctccgcctggcctccaacgccatctgcagcgcggtgcccgtgcactgggtccccacctcccggaccacctggagcatccacgcccaccaccagtggatgacgaccgaggacatgctgaccgtgtggaaccgcgtgtggatcgaggacaacccgtggatggaggacaagacccccgtcacgacctgggagaacgtgccctacctcgggaagcgggaggaccagtggtgcggcagcctgatcgggctgacctcccgcgccacctgggcccagaacatcccgacggccatccagcaggtccggagcctcatcggcaacgaggagttcctggactacatgccctccatgaagcgcttccggaaggaggaggagagcgagggggcgatctggtga

SEQ ID NO: 9923 - RNA, 9873 nt, synthetic construct
  misc_feature 1..9873: note = derived and/or modified CDS sequence (opt1) from DENV-3__FJ898464__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcgcacggcgaccctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcgtgttcccgtacagcatccccgcgaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgcggagccggacggccccacccccgagctggaggaggagatgttcaagaagcggaacctcaccatcatggacctgcaccccgggagcggcaagacccgcaagtacctgccggccatcgtccgggaggccatcaagcgccggctccgcacgctgatcctggcccccacccgggtggtggccgcggagatggaggaggccctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcgtccatcgccgcccgcgggtacatcagcacccgggtcggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggcggaccgggtcatcgacccgcgccggtgcctcaagcccgtgatcctgacggacggccccgagcgcgtgatcctggccgggcccatgccggtcaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggcgctcaaggagttcaaggacttcgccgccggccgcaagagcatcgccctggacctggtgacggagatcgggcgggtgccctcccacctcgcccaccgcacccggaacgcgctggacaacctggtcatgctccacaccagcgagcacggcgggcgcgcctaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcgcacgccccaggacaaccagctggcctacgtggtcatcgggatcctcacgctggccgcgatcatcgccgccaacgagatgggcctgctcgagaccaccaagcgggacctgggcatgtccaaggagccgggggtggtgagccccacctcctacctggacgtcgacctccaccccgccagcgcgtggacgctgtacgccgtggccaccaccgtgatcacccccatgctgcgccacacgatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacgcactacgccatcatcggccccggcctccaggccaaggccacccgggaggcccagaagcgcaccgcggccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggcgctgaccctggccaccggccccatcacgaccctctgggagggctcccccgggaagttctggaacaccaccatcgccgtgagcatggccaacatcttccgcggctcctacctggccggggcgggcctggccttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagacgacccaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgccggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggcgaccgggagcgcctccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgcggccatgggcgccgtgttcacggaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcgcagctcatccggcagatggagggcgagggggtgctgagcaaggccgacctggagaacccccacctcccggagaagaagatcacccagtggctggagacgaagggcgtcgagcgcctgaagcggatggccatctccggcgacgactgcgtggtgaagcccatcgacgaccgcttcgccaacgccctcctggcgctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctccgcgagaccgcctgcctgggcaaggcgtacgcccagatgtggagcctgatgtacttccaccgccgggacctccgcctggcctccaacgccatctgcagcgccgtgcccgtgcactgggtcccgacctcccggaccacgtggagcatccacgcgcaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgacctcccgcgccacgtgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 9924 - RNA, 9873 nt, synthetic construct
  misc_feature 1..9873: note = derived and/or modified CDS sequence (opt1) from DENV-3__JQ922556__SS-prME
  source 1..9873: mol_type = other RNA
accagcctgtgcctcatgatgatcctgcccgccgccctggcgttccacctcacctcccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgggacaagcggtccgtcgccctcgcgccccacgtgggcatggggctggacacccggacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggcccccgcccggggcgcccgccggatggccatcctgggcgacaccgcgtgggtgttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacatggggtgcgtgatcaactggaagggcaaggagctgaagtgcggcagcgggatcttcgtgaccaacgaggtccacacgtggaccgagcagtacaagttccaggccgactcccccaagcgcctcgccaccgccatcgccggcgcgtgggagaacggggtgtgcggcatccgcagcaccacgcggatggagaacctgctgtggaagcagatcgccaacgagctcaactacatcctgtgggagaacaacatcaagctgaccgtggtcgtgggggacaccatcggcgtgctcgagcagggcaagcgcaccctgacgccgcagcccatggagctgaagtactcctggaagacctgggggaaggccaagatcgtcaccgccgagacccagaacagctccttcatcatcgacggccccagcacgcccgagtgcccgtccgcgagccgggcctggaacgtgtgggaggtggaggactacgggttcggcgtcttcaccaccaacatctggctcaagctgcgcgaggtgtacacccagatgtgcgaccaccggctgatgagccccgccgtgaaggacgagcgcgccgtccacgccgacatgggctactggatcgagtcccagaagaacgggagctggaagctcgagaaggcgtccctgatcgaggtgaagacctgcacgtggcccaagagccacaccctgtggtccaacggcgtgctcgagagcgacatgatcatcccgaagtccctggccgggcccatcagccagcacaactaccggcccggctaccacacccagaccgccgggccctggcacctgggcaagctcgagctggacttcaactactgcgagggcacgaccgtcgtgatcaccgagaactgcgggacccgcggcccgtccctgcggacgaccaccgtgagcgggaagctcatccacgagtggtgctgccgctcctgcaccctgccgcccctgcggtacatgggcgaggacgggtgctggtacggcatggagatccgccccatcagcgagaaggaggagaacatggtcaagtccctcgtgagcgccggctccgggaaggtggacaacttcacgatgggcgtcctgtgcctggccatcctcttcgaggaggtgatgcgggggaagttcggcaagaagcacatgatcgcgggggtgttcttcaccttcgtcctgctgctcagcggccagatcacctggcgcgacatggcccacaccctgatcatgatcggctccaacgccagcgaccggatggggatgggcgtgacgtacctggccctcatcgccaccttcaagatccagccgttcctggcgctggggttcttcctccgcaagctgaccagccgggagaacctgctcctgggcgtgggcctggccatggccaccacgctccagctgcccgaggacatcgagcagatggccaacgggatcgcgctgggcctcatggccttcaagctgatcacccagttcgagacctaccagctgtggaccgccctcatctccctgacgtgcagcaacaccatcttcaccctgaccgtcgcctggcgcacggccaccctcatcctggcgggggtgtccctgctccccgtctgccagagctccagcatgcggaagaccgactggctgcccatgaccgtggccgccatgggcgtgccgcccctgcccctcttcatcttctccctgaaggacacgctgaagcgccgcagctggcccctcaacgagggggtcatggccgtgggcctggtgtccatcctggccagctccctcctgcggaacgacgtcccgatggcgggccccctggtggccgggggcctcctgatcgcctgctacgtggggaccggcaccagcgccgacctgaccgtcgagcaggccgcggacgtgacgtgggaggaggaggccgagcagaccggggtgtcccacaacctcatgatcaccgtcgacgacgacggcaccatgcgcatcaaggacgacgagaccgagaacatcctgacggtgctgctcaagaccgccctgctgatcgtgagcggcatcttcccctactccatccccgccaccctcctggtctggcacacctggcagaagcagacgcagcggagcggggtgctgtgggacgtgccgagcccgcccgagacccagaaggccgagctcgaggagggcgtctaccgcatcaagcagcaggggatcctgggcaagacccaggtgggggtgggcgtccagaaggagggcgtgttccacaccatgtggcacgtgacgcgcggggcggtcctgacccacaacggcaagcgcctcgagcccaactgggccagcgtgaagaaggacctgatctcctacgggggcgggtggcggctgagcccgcagtggcagaagggcgaggaggtgcaggtcatcaccgtggagcccggcaagaaccccaagaacttccagaccatgccggggacgttccagaccaccaccggcgagatcggggccatcgccctcgacttcaagcccggcacgagcggctcccccatcatcaaccgcgaggggaaggtggtcggcctgtacgggaacggcgtggtgaccaagaacgggggctacgtcagcggcatcgcgcagaccaacgccgagcccgacgggccgacccccgagctggaggaggagatgttcaagaagcggaacctgacgatcatggacctccaccccggctccgggaagacccgcaagtacctgcccgccatcgtgcgggaggccatcaaccgccggctgcgcaccctcatcctggccccgacccgggtggtcgcggccgagatggaggaggccctgaagggcctccccatccgctaccagacgaccgccaccaagagcgagcacaccgggcgggagatcgtggacctgatgtgccacgccacgttcaccatgcgcctgctctcccccgtgcgggtccccaactacaacctgatcatcatggacgaggcgcacttcaccgacccggccagcatcgccgcccgcggctacatctccacccgggtgggcatgggggaggccgcggccatcttcatgacggccacgccgcccggcaccgccgacgcgttcccccagagcaacgccccgatccaggacgaggagcgcgacatccccgagcgctcctggaacagcgggaacgagtggatcaccgacttcgccggcaagacggtgtggttcgtcccctccatcaaggccgggaacgacatcgccaactgcctgcggaagaacggcaagaaggtgatccagctcagccgcaagaccttcgagaccgagtaccagaagaccaagctgaacgactgggacttcgtgggcacgaccgacatctccgagatgggggcgaacttcaaggccgaccgggtcatcgacccccgccggtgcctgaagccgggcatcctcaccgacgggcccgagggcgtgatcctggccgggcccatgcccgtgaccgccgccagcgcggcccagcgccggggccgcgtcggccggaacccgcagaaggagaacgaccagtacatcttcaccgggcagcccctgaacaacgacgaggaccacgcccactggacggaggccaagatgctcctggacaacatcaacacccccgagggcatcatccccgccctgttcgagccggagcgcgagaagtccgcggccatcgacggggagtaccggctcaagggcgagagccgcaagaccttcgtggagctgatgcggcgcggcgacctgcccgtgtggctcgcccacaaggtcgcctccgaggggatcaagtacaccgaccggaagtggtgcttcgacggccagcgcaacaaccagatcctggaggagaacatggacgtggagatctggacgaaggagggggagaagatcaagctgcggccccgctggctcgacgcgcggacctacagcgacccgctggccctgaaggagttcaaggacttcgccgccggccgcaagtccatcgccctcgacctggtcaccgagatcgggcgcgtgcccagccacctggcgcaccggacccgcaacgccctcgacaacctggtgatgctgcacacgagcgagcacggcggccgggcctaccgccacgccgtcgaggagctccccgagaccatggagaccctgctgctcctggggctgatgatcctcctgaccggcggggccatgctgttcctcatctccggcaaggggatcggcaagacgagcatcggcctgatctgcgtgatcgcgtccagcgggatgctgtggatggccgagatccccctccagtggatcgcctccgccatcgtgctggagttcttcatgatggtcctgctcatcccggagcccgagaagcagcggacgccccaggacaaccagctggcctacgtggtgatcggcatcctgaccctcgcggccatcatcgccgccaacgagatggggctgctggagaccacgaagcgcgacctcggcgtcagcaaggagcccggggtggtgtccccgaccagctacctggacgtcgacctgcaccccgcctccgcgtggaccctctacgccgtggccaccacggtgatcacccccatgctgcggcacaccatcgagaacagcaccgccaacgtctccctggcggccatcgccaaccaggccgtggtgctcatgggcctggacaagggctggcccatcagcaagatggacctgggggtcccgctcctggccctgggctgctactcccaggtgaaccccctcacgctgaccgcggccgtgctgctcctgatcacccactacgccatcatcgggcccggcctgcaggccaaggccacccgcgaggcgcagaagcggacggccgccggcatcatgaagaaccccaccgtcgacgggatcatcaccatcgacctcgacccggtgatctacgacagcaagttcgagaagcagctgggccaggtgatgctgctcgtcctgtgcgccgtgcagctgctcctgatgcgcacctcctgggccctgtgcgaggcgctcacgctggccaccgggcccatcaccaccctgtgggagggcagccccgggaagttctggaacacgaccatcgccgtgtccatggccaacatcttccggggcagctacctcgcgggcgccgggctggccttctccatcatgaagtccgtcggcaccgggaagcgcggcaccgggagccagggcgagaccctgggcgagaagtggaagaagaagctcaaccagctgagccggaaggagttcgacctgtacaagaagtccgggatcacggaggtggaccgcaccgaggccaaggagggcctcaagcgcggggagctgacccaccacgccgtgtcccgcggcagcgcgaagctgcagtggttcgtcgagcggaacatggtgatccccgaggggcgcgtgatcgacctcggctgcggccgcggcgggtggtcctactactgcgccgggctgaagaaggtcaccgaggtgcgcgggtacacgaagggcggcccgggccacgaggagcccgtgcccatgagcacctacgggtggaacatcgtcaagctgatgtccggcaaggacgtgttctacctcccgcccgagaagtgcgacaccctgctgtgcgacatcggggagagctcccccagccccaccgtggaggagtcccggacgatccgcgtcctgaagatggtggagccctggctcaagaacaaccagttctgcatcaaggtgctgaacccctacatgcccgccgtcatcgagcacctggagcgcctccagcggaagcacggcggcatgctggtgcgcaaccccctgagccggaactccacccacgagatgtactggatcagcaacgggaccggcaacatcgtgtccagcgtcaacatggtgtcccgcctcctgctgaaccggttcaccatgacgcaccgccggccgaccatcgagaaggacgtggacctcggggccggcacccgccacgtcaacgccgagcccgagacccccaacatggacgtgatcggggagcggatcaagcgcatcaaggaggagcacaacagcacgtggcactacgacgacgagaacccctacaagacctgggcgtaccacggctcctacgaggtgaaggccaccggcagcgggagctccatgatcaacggcgtcgtgaagctgctgaccaagccgtgggacgtcgtgcccatggtgacgcagatggccatgaccgacaccacccccttcgggcagcagcgggtcttcaaggagaaggtggacacgcgcacgccccggccgatgcccggcacccgcaaggtgatggagatcaccgccgagtggctctggcggacgctggggcgcaacaagcggccccgcctgtgcacccgggaggagttcaccaagaaggtccgcaccaacgccgcgatgggcgccgtgttcacggaggagaaccagtgggacagcgccaaggccgcggtggaggacgaggagttctggaagctcgtcgaccgcgagcgggagctgcacaagctgggcaagtgcgggtcctgcgtgtacaacatgatgggcgggcgcgagaagaagctcggcgagttcgggaaggccaagggcagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgcgatgtacgccgacgacaccgccgggtgggacacccggatcaccgaggacgacctgcacaacgaggagaagatcacgcagcagatggacccggagcaccgcctcctggccaacgccatcttcaagctgacctaccagaacaaggtcgtgaaggtgcagcggcccacccccaccggcaccgtcatggacatcatctcccgcaaggaccagcgggggagcggccaggtgggcacgtacgggctcaacaccttcaccaacatggaggcgcagctggtgcgccagatggagggcgagggggtcctgtccaaggccgacctcgagaacccccacctccccgagaagaagatcacccagtggctggagacgaagggcgtggagcggctgaagcgcatggccatcagcggggacgactgcgtggtcaagcccatcgacgaccggttcgccaacgccctgctggcgctcaacgacatgggcaaggtgcgcaaggacatcccccagtggcagccctccaagggctggcacgactggcagcaggtcccgttctgcagccaccacttccacgagctgatcatgaaggacgggcggaagctggtcgtgccctgccgcccccaggacgagctcatcggccgggcccgcatctcccagggggccggctggagcctgcgggagaccgcctgcctggggaaggcctacgcgcagatgtggtccctcatgtacttccaccgccgcgacctgcggctggccagcaacgccatctgctccgccgtgcccgtccactgggtgaccaccagccgcacgacctggagcatccacgcgcaccaccagtggatgaccaccgaggacatgctcacggtgtggaaccgggtctggatcgaggacaacccgtggatggaggacaagacccccgtgaccacctgggagaacgtgccctacctgggcaagcgcgaggaccagtggtgcggctccctgatcgggctcacgagccgggccacctgggcccagaacatcccgaccgccatccagcaggtccgctccctgatcggcaacgaggagttcctggactacatgcccagcatgaagcggttccgcaaggaggaggagtccgagggggccatctggtga

SEQ ID NO: 9925 - RNA, 9873 nt, synthetic construct
  misc_feature 1..9873: note = derived and/or modified CDS sequence (opt1) from DENV-3__JQ922557__SS-prME
  source 1..9873: mol_type = other RNA
accagcctgtgcctcatgatgatcctgcccgccgccctggcgttccacctcaccagccgcgacggggagccgcggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagcggctgtccggcgccacctgggtggacgtggtcctggagcacgggggctgcgtgaccacgatggccaagaacaagcccaccctcgacatcgagctgcagaagaccgaggccacccagctggcgacgctccgcaagctgtgcatcgaggggaagatcaccaacatcaccaccgacagccggtgccccacgcagggcgaggccgtgctgccggaggagcaggaccagaactacgtctgcaagcacacctacgtggaccgcggctgggggaacggctgcggcctgttcggcaaggggtccctggtgacctgcgccaagttccagtgcctggagcccatcgagggcaaggtcgtgcagtacgagaacctcaagtacaccgtgatcatcacggtccacaccggcgaccagcaccaggtggggaacgagacccagggcgtcaccgccgagatcacgccccaggccagcaccaccgaggcgatcctgcccgagtacgggaccctgggcctcgagtgctccccgcggaccgggctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctgggctcccaggagggggcgatgcacaccgccctcacgggcgccaccgagatccagaacagcgggggcacctccatcttcgccgggcacctgaagtgccgcctgaagatggacaagctcgagctgaagggcatgagctacgccatgtgcaccaacacgttcgtcctgaagaaggaggtgtccgagacccagcacggcaccatcctcatcaaggtggagtacaagggggaggacgcgccgtgcaagatccccttcagcaccgaggacggccaggggaaggcccacaacggccggctgatcacggccaaccccgtcgtgaccaagaaggaggagcccgtgaacatcgaggccgagccgcccttcggcgagagcaacatcgtcatcgggatcggcgacaacgcgctgaagatcaactggtacaagaaggggtccagcatcggcaagatgttcgaggccaccgcccgcggggcccggcgcatggccatcctgggcgacaccgcgtgggacttcggctccgtcggcggggtgctcaacagcctggggaagatggtccaccagatcttcgggtccgcctacacggccctgttcagcggggtgtcctgggtgatgaagatcggcatcggcgtcctcctgacctggatcgggctgaacagcaagaacacctccatgagcttctcctgcatcgccatcggcatcatcaccctctacctgggggccgtggtgcaggcggacatgggctgcgtcatcaactggaaggggaaggagctgaagtgcggcagcggcatcttcgtgacgaacgaggtgcacacctggaccgagcagtacaagttccaggccgactcccccaagcgcctcgccaccgccatcgccggggcgtgggagaacggcgtctgcgggatccggagcacgacccgcatggagaacctgctgtggaagcagatcgccaacgagctcaactacatcctgtgggagaacaacatcaagctgaccgtggtggtcggcgacaccatcggggtgctcgagcagggcaagcggacgctgacgccccagccgatggagctgaagtactcctggaagacctggggcaaggccaagatcgtgaccgccgagacgcagaacagctccttcatcatcgacgggcccaacacccccgagtgccccagcgcgtcccgcgcctggaacgtctgggaggtggaggactacggcttcggggtgttcaccaccaacatctggctcaagctgcgggaggtctacacccagatgtgcgaccaccgcctgatgagcgccgccgtgaaggacgagcgggccgtgcacgcggacatgggctactggatcgagagccagaagaacggctcctggaagctcgagaaggccagcctgatcgaggtcaagacgtgcacctggccgaagtcccacaccctgtggagcaacggggtgctcgagtccgacatgatcatccccaagagcctggccggccccatctcccagcacaactaccgcccggggtaccacacccagacggccggcccctggcacctggggaagctcgagctggacttcaactactgcgagggcaccaccgtggtcatcaccgagaactgcggcacgcgggggcccagcctgcgcaccaccaccgtgtccggcaagctcatccacgagtggtgctgccggagctgcacgctgcccccgctgcgctacatgggggaggacggctgctggtacgggatggagatccggcccatctccgagaaggaggagaacatggtgaagtccctcgtctccgccggcaagagcaagcgcgacaactccaccatgggcgtgctgtgcctggcgatcctcttcgaggaggtgatgcgggggaagttcggcaagaagcacatgatcgccggggtcttcttcaccttcgtgctgctgctcagcggccagatcacctggcgcgacatggcccacacgctgatcatgatcgggtccaacgccagcgaccggatgggcatgggcgtgacctacctggccctcatcgcgaccttcaagatccagcccttcctggccctggggttcttcctccgcaagctgaccagccgggagaacctgatgctcggcgtcgggctggccatggccacgaccctgcagctccccgaggacatcgagcagatggcgaacggcatcgccctgggcctgatggccctcaagctgatcacccagttcgagacctaccagctgtggacggccctcatctccctgacctgcagcaacaccatcttcaccctgacggtggcctggcgcaccgcgaccctcatcctggccggggtgtccctgctcccggtctgccagagctccagcatgcgcaagaccgactggctgcccatgacggtggccgccatgggcgtgccgcccctgcccctcttcatcttctccctgaaggacaccctgaagcggcgcagctggcccctcaacgagggggtgatggccgtgggcctggtctccatcctggcgagctccctcctgcggaacgacgtgcccatggccgggcccctggtggccggcggcctcctgatcgcctgctacgtcatcaccgggaccagcgccgacctgacggtggagaaggcggccgacgtgacctgggaggaggaggccgagcagaccggcgtctcccacaacctcctgatcaccgtggacgacaacgggaccatgcgcatcaaggacgacgagacggagatcatcctgaccgtgctcctgaagaccgccctgcagatcgtcagcggcatcttcccgtactccatccccgccaccctcctggtgtggcacacgtggcagaagcagacccagcggagcggggtgctgtgggacgtccccagcccgcccgagacccagaaggcggagctcgaggagggcgtgtaccgcatcaagcagcagggcatcctggggaagacccaggtgggcgtcggggtgcagaaggagggcgtgttccacacgatgtggcacgtcacccgcggggccgtgctgacccacaacggcaagcgcctcgagcccaactgggccagcgtgaagaaggacctgatctcctacggcgggggctggcggctgagcgcccagtggcagaagggggaggaggtccaggtgatcgcggtggagcccggcaagaaccccaagaacttccagaccatgcccgggacgttccagaccaccaccggcgagatcggcgccatcgccctcgacttcaagcccgggacgagcggctcccccatcatcaaccgcgaggggaaggtcgtgggcctgtacggcaacggggtggtcaccaagaacggcgactacctgagcgggatcgcccagaccaacgccgagccgtacggcccctcccccgacctggaggaggagatgttcaagaagcggaagctcaccatcatggacctgcaccccgggagcggccagacgctgaagtacctcccggcgatcgtgcgcgacgccatcaagcggcgcctgcggatcctgatcctcgcccccacccgcgtggtcgccgccgagatggaggaggcgctgaagggcctgcccatccggtaccagaccaccgccacgaagtccgagcacaccgggcgcgagatcgtggacctcatgtgccacgccaccttcaccatgcggctgctgagccccgtgcgcgtcccgaactacaacctcatcatcatggacgaggcccacttcacggaccccgcctccatcgcggcccggggctacatcagcacccgcgtggggatgggcgaggccgccgcgatcttcatgaccgccacgccgcccgggacggccgacgccttcccgcagtccaacgcccccatccaggacgcggagcgcgacatccccgagcggagctggaactccggcaacgagtggatcaccgacttcgccggcaagaccgtgtggttcgtccccagcatcaaggccgggaacgacatcgccaactgcctgcgcaagaacggcaagaaggtgatccagctgtcccggaagaccttcgagacggagtaccagaagaccaagctcaacgactgggacttcgtggtcaccaccgacatcagcgagatgggggccaacttcaaggcggaccgcgtgatcgacccgcggcgctgcctgaagcccgtgatcctgacggacggccccaagcgggtcatcctcgccgggcccatgccggacaccgccgcctccgccgcgcagcgccggggccgcgtgggccggaacccccagaaggagaacgaccagtacatcttccccgggcagcccctgaacaccgacgaggaccacgcccactggccggagaccaagctgctcatggacctgttcaccacgcccgagggcatcctgcccagccacttcgacccccacggggagaacttcccggagatctccggcgagtaccgcctcaagggggagagccggaagaccttcgtggagctgatgcgccggggcgacctgcccgtctggctcgcccacaaggtggcctccgagggcatcaagtacaccgaccgcaagtggtgcttcgacgggcagcggaacaaccagatcctggaggagaacatggacgtggagatctggaccaaggagggcgagaagaagaagctgcgcccccggtggctcgacgcgcgcacgtacagcgacccgctggccctgaaggagttcaaggacttcgccgccgggcgcaagagcatcgccctcgacctggtcaccgagatcggccgggtgccctcccacctggcgcaccgcacccggaacgccctcgacaacctggtcatgctgcacaccagcgagcacggcgggcgcgcctaccggcacgccgtggaggagctccccgagacgatggagaccctgctgctcctgggcctgatgatcctcctgaccgggggcgccatgctgttcctcatctccgggaagggcatcggcaagaccagcatcgggctgatctgcgtgatcgcgtccagcggcatgctgtggatggccgagatccccctccagtggatcgcctccgccatcgtcctggagttcttcatgatggtgctgctcatcccggagcccgagaagcagcgcacgccccaggacaaccagctggcctacgtggtcatcgggatcctgaccctcgcggccatcatcgccgccaacgagatgggcctgctggagaccaccaagcgggacctcgggatgagcaaggagcccggcgtggtgtccccgacgagctacctggacgtcgactcccaccccgccagcgcgtggaccctgtacgccgtggccaccaccgtgatcacgcccatgctccgccacaccatcgagaactccaccgccaacgtcagcctggcggccatcgccaaccaggccgtggtgctgatgggcctcgacaaggggtggcccatctccaagatggacctgggcgtcccgctgctcgccctggggtgctacagccaggtgaaccccctgaccctcacggcggccgtgctgctgctcatcacccactacgccatcatcggccccgggctgcaggccaaggccacccgggaggcgcagaagcgcaccgccgccggcatcatgaagaaccccacggtcgacggcatcatcaccatcgacctggacccggtgatctacgactccaagttcgagaagcagctcggccaggtgatgctgctggtcctctgcgccgtgcagctgctgctcatgcggaccagctgggccctgtgcgaggcgctgaccctcgccacgggccccatgaccaccctgtgggaggggtcccccggcaagatctggaacaccacgatcgccgtgagcatggccaacatcttccgcggcagctacctggcgggggccggcctcgccttctccatcatgaagtccgtcgggaccggcaagcgggggaccggctcccagggcgagaccctgggggagaagtggaagaagaagctgaaccagctcagccgcaaggagttcgacctgtacaagaagtccggcatcaccgaggtggaccggacggaggccaaggaggggctgaagcgcggcgagaccacccaccacgccgtgagccgggggtccgcgaagctccagtggttcgtcgagcgcaacatggtgatccccgagggccgggtgatcgacctgggctgcgggcgcggcgggtggagctactactgcgccggcctgaagaaggtcaccgaggtgcgggggtacacgaagggcggcccggggcacgaggagcccgtgcccatgtccacctacggctggaacatcgtcaagctcatgagcgggaaggacgtgttctacctgcccccggagaagtgcgacaccctgctgtgcgacatcggcgagtccagcccctcccccaccgtggaggagagccgcacgatccgcgtcctcaagatggtggagccctggctgaagaacaaccagttctgcatcaaggtgctgaacccgtacatgcccgccgtcatcgagcacctcgagcggctgcagcgcaagcacgggggcatgctggtgcggaaccccctctcccgcaacagcacccacgagatgcactggatctccaacggcaccgggaacatcgtgagctccgtcaacatggtgagccggctgctgctcaaccgcttcaccatgacgcaccggcgcccgaccatcgagaaggacgtggacctgggcgccgggacccggcacgtcaacgccgagcccgagacccccaacatggacgtgatcggcgagcgcatcaagcggatcaaggaggagcacaacagcacgtggcactacgacgacgagaacccctacaagacctgggcgtaccacggctcctacgaggtgaaggccaccgggagcgcctccagcatgatcaacggcgtcgtgaagctgctcaccaagccgtgggacgtggtccccatggtgacgcagatggccatgaccgacaccacccccttcgggcagcagcgcgtcttcaaggagaaggtggacacgcggacgccccggccgatgcccggcacccggaaggtgatggagatcaccgccgagtggctgtggcgcacgctggggcggaacaagcgcccccggctctgcacccgcgaggagttcaccaagaaggtccgcaccaacgcggccatgggcgccgtgttcacggaggagaaccagtgggactccgccaaggcggccgtggaggacgaggagttctggaagctggtcgaccgggagcgcgagctgcacaagctcggcaagtgcgggagctgcgtgtacaacatgatgggcaagcgggagaagaagctgggggagttcggcaaggccaaggggtcccgcgccatctggtacatgtggctgggcgcccggtacctcgagttcgaggcgctgggcttcctgaacgaggaccactggttcagccgcgagaactcctacagcggggtggagggcgaggggctccacaagctgggctacatcctgcgggacatctccaagatccccgggggcgccatgtacgccgacgacaccgccggctgggacacccgcatcaccgaggacgacctccacaacgaggagaagatcacgcagcagatggacccggagcaccggctgctggccaacgcgatcttcaagctcacctaccagaacaaggtcgtgaaggtgcagcgccccacccccaccgggaccgtcatggacatcatcagccggaaggaccagcgcggctccggccaggtgggcacgtacggcctgaacaccttcaccaacatggaggcccagctggtgcggcagatggagggggagggcgtcctcagcaaggccgacctggagaacccccacctcccggagaagaagatcacccagtggctcgagacgaagggggtggagcgcctgaagcggatggccatctccggcgacgactgcgtggtcaagcccatcgacgaccgcttcgccaacgcgctgctcgccctgaacgacatggggaaggtgcggaaggacatcccccagtggcagcccagcaagggctggcacgactggcagcaggtcccgttctgctcccaccacttccacgagctgatcatgaaggacggccgcaagctcgtcgtgccctgccggccccaggacgagctgatcgggcgcgcccggatcagccagggcgccgggtggtccctgcgcgagaccgcctgcctcggcaaggcgtacgcccagatgtggagcctgatgtacttccaccgccgggacctgcgcctcgccagcaacgccatctgctccgcggtgcccgtccactgggtgccgaccagccggaccacgtggtccatccacgcccaccaccagtggatgaccaccgaggacatgctgaccgtgtggaaccgcgtctggatcgaggacaacccctggatggaggacaagacgcccgtgaccacctgggagaacccgccctacctggggaagcgggaggaccagtggtgcggcagcatcatcggcctctccagccgcgccacctgggcccagaacatccccacggccatccagcaggtccggtccctgatcgggaacgaggagttcctggactacatgcccagcatgaagcgcttccggaaggaggaggagtccgagggcgcgatctggtga

SEQ ID NO: 9926 - RNA, 9873 nt, synthetic construct
  misc_feature 1..9873: note = derived and/or modified CDS sequence (opt1) from DENV-3__JQ922555__SS-prME
  source 1..9873: mol_type = other RNA
accagcctgtgcctgatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccaccccgggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagtacgagaacctcaagtacaccgtgatcatcacggtccacaccggggaccagcaccaggtgggcaacgagacccagggggtcaccgccgagatcacgccccaggcctccaccgcggaggccatcctgcccgagtacggcaccctggggctcgagtgcagcccccgcaccggcctggacttcaacgagatgatcctgctcaccatgaagaacaaggcctggatgggccaccggcagatgctgttcgacctgccgacgccctggacctccgggaccaccacggagaccagcgcctggaaccgcaaggagcccttcgtgaccttcaagaacgcccacaccaagaagcaggaggtggtcgtgctcggctcccaggagggggcgatgcacacggccctgaccggcgccaccgagatccagaacagcgggggcacctccatcttcgccggccacctgaagtgccggctcaagatggacaagctggagctgaaggggatgagctacgccatgtgcacgaacaccttcgtgctcaagaaggaggtcagcgagacccagcacggcaccatcctggtgaaggtggagtacaagggggaggacgcgccctgcaagatcccgttctccacggaggacggccagggcaaggcccacaacgggcgcctgatcaccgccaaccccgtcgtgaccaagaaggaggagcccgtgaacatcgaggccgagcccccgttcggcgagagcaacatcgtcatcgggatcggcgacaaggcgctcaagatcaactggtaccggaaggggtccagcatcggcaagatgttcgaggccacctcccgcggcgcccggcgcatggccatcctgggggacacggcctgggacttcggcagcgtcggcggggtgctgaactccctggggaagatggtccaccagatcttcgggagcgcgtacaccgccctcttctccggcgtgagctgggtgatgaagatcgggatcggcgtcctgctgacctggatcgggctcaactccaagaacaccagcatgtccttcagctgcatcgccatcggcatcatcacgctgtacctgggggccgtggtgcaggccgacatgggctgcgtcatcaactggaagggcaaggagctcaagtgcgggtccggcatcttcgtgaccaacgaggtgcacacctggaccgagcagtacaagttccaggcggacagccccaagcgcctggccacggccatcgccggggcctgggagaacggcgtctgcgggatccggtccaccacccgcatggagaacctgctctggaagcagatcgcgaacgagctgaactacatcctgtgggagaacaacatcaagctcaccgtggtggtcggcgacacgatcggcgtgctggagcaggggaagcggaccctgacgccccagcccatggagctcaagtacagctggaagacctggggcaaggccaagatcgtgacggccgagacccagaactccagcttcatcatcgacgggccgaacacccccgagtgccccagcgcctcccgcgcgtggaacgtctgggaggtggaggactacggcttcggcgtgttcaccaccaacatctggctgaagctgcgggaggtctacacgcagatctgcgaccaccgcctcatgagcgccgccgtgaaggacgagcgggccgtgcacgccgacatggggtactggatcgagtcccagaagaacggcagctggaagctggagaaggcgtccctgatcgaggtcaagaccagcacctggcccaagtcccacaccctctggagcaacggggtgcaggagtccgacatgatcatccccaagagcctggccggccccatctcccagcacaactaccgccccgggtaccacacgcagaccgccggcccgtggcacctgggcaagctcgagctggacttcaactactgcgaggggaccaccgtggtcatcacggagaactgcggcacccgggggcccagcctgcgcaccaccacggtgtccggcaagctcatccacgagtggtgctgccggagctgcaccctgccgcccctccgctacatgggggaggacggctgctggtacggcatggagatccggccgatctccgagaaggaggagaacatggtcaagagcctcgcctccgccgggagcggcaaggtcgacaacttcaccatgggggtgctgtgcctggcgatcctcttcgaggaggtgatgcgcggcaagttcgggaagaagcacatgatcgccggcgtcctgttcaccttcgtgctgctcctgagcggccagatcacgtggcgggacatggcccgcaccctgatcatgatcgggtccaacgccagcgaccggatgggcatgggggtgacctacctcgccctgatcgcgaccttcaagatccagcccttcctggccctcggcttcttcctgcgcaagctgacgtcccgggagaacctcctgctgggcgtcgggctcgccatggccaccaccctgcagctgcccgaggacatcgagcagatggcgaacggcatcgccctcgggctgatggccctgaagctcatcacccagttcgagacgtaccagctgtggaccgccctggtgagcctgacctgctccaacaccatcttcacgctgaccgtggcctggcgcaccgcgaccctgatcctcgccggcgtcagcctgctgcccgtgtgccagtccagctccatgcgcaagacggactggctcccgatgaccgtcgccgccatgggggtgccgcccctgcccctgttcatcttcagcctcaaggacaccctgaagcggcgctcctggccgctgaacgagggcgtgatggccgtcggcctcgtgagcatcctggcgtccagcctgctccggaacggggtgcccatggccggccccctggtcgccgggggcctgctcatcgcctgctacgtgatcaccgggacgtccgccgacctgaccgtggagaaggcggccgacgtcacctgggaggaggaggccgagcagaccggcgtgagccacaacctgatgatcaccgtggacgacgacggcacgatgcgcatcaaggacgacgagaccgagaacatcctcaccgtcctgctgaagaccgccctcctgatcgtgtccgggatcttcccctacagcatcccggccacgctgctcgtgtggcacacctggcagaagcagacccagcggtccggcgtcctgtgggacgtgccctccccgcccgagacccagaaggcggagctggaggagggggtgtaccgcatcaagcagcagggcatcttcgggaagacgcaggtcggcgtgggcgtgcagaaggagggggtcttccacaccatgtggcacgtgacccggggcgccgtgctcacccacaacgggaagcgcctggagccgaactgggccagcgtcaagaaggacctgatctcctacggcgggggctggcggctcagcgcccagtggcagaagggcgaggaggtccaggtgatcgcggtcgagcccgggaagaaccccaagaacttccagacgatgcccggcaccttccagaccacctccggggagatcggcgccatcgccctggacttcaagccgggcacgagcgggtcccccatcatcaaccgcgagggcaaggtggtggggctgtacggcaacggggtcgtgaccaagaacggcggctacgtgagcgggatcgcccagaccaacgccgagcccgacggcccgacccccgagctcgaggaggagatgttcaagaagcggaacctgacgatcatggacctgcaccccgggtccggcaagacccgcaagtacctgcccgcgatcgtccgggaggccatcaagcgccggctccgcaccctgatcctggccccgacccgggtggtggccgccgagatggaggaggcgctcaaggggctgcccatccgctaccagacgaccgccaccaagagcgagcacaccggccgggagatcgtcgacctgatgtgccacgccacgttcaccatgcgcctcctgtcccccgtgcgggtgcccaactacaacctgatcatcatggacgaggcccacttcaccgacccggccagcatcgcggcccgcggctacatctccacccgcgtcgggatgggcgaggccgccgcgatcttcatgacggccacgccgcccgggaccgccgacgccttcccccagagcaacgccccgatccaggacgaggagcgggacatccccgagcgctcctggaacagcggcaacgagtggatcaccgacttcgcggggaagacggtgtggttcgtgccctccatcaaggccggcaacgacatcgccaactgcctccggaagaacggcaagaaggtcatccagctgagccgcaagaccttcgacaccgagtaccagaagaccaagctgaacgactgggacttcgtggtgacgaccgacatctccgagatgggggccaacttcaaggccgaccgggtcatcgacccccgccggtgcctcaagccggtgatcctgaccgacggccccgagcgcgtgatcctggcggggcccatgcccgtcaccgccgccagcgccgcccagcggcgcggccgggtggggcgcaacccgcagaaggagaacgaccagtacatcttcaccggccagcccctcaacaacgacgaggaccacgcgcactggacggacgccaagatgctgctggagaacatcaacacccccgagggcatcatccccgccctcttcgagccggagcgggagaagtccgccgggctggacggcgagtaccgcctgaagggggagagccggaagaccttcgtggagctcatgcgccggggcgacctgcccgtctggctggcgcacaaggtggccagcgagggcatcctctacaccgaccgcaagtggtgcttcgacgggcagcggaacaaccagatcctggaggagaacatggacgtcgagatctggacgaaggagggcgagaagaagaagctgcgcccccgctggctcgacgcccggacctactccgaccccctggccctgaaggagttcaaggacttcgccgcggggcgcaagagcatcgccctcgacctggtgaccgagatcggccgggtgtccagccacctggcccaccgcacccggaacgccctcgacaacaagatgatgctgcacacgtccgagtacgggggccgcgcctaccggcacgcggtcgaggagctgccggagaccatggagaccctcctgctgctcggcctgatgatcctgctcaccgggggcgccatgctgttcctgatcagcgggaagggcatcgggaagacgtccatcggcctcatctgcgtgatcgccagctccggcatgctgtggatggccgacgtgcccctgcagtggatcgccagcgcgatcgtcctcgagttcttcatgatggtgctgctgatccccgagccggagaagcagcgcacgccccaggacaaccagctcgcctacgtggtcatcgggatcctgaccctggccgccatcatcgccgcgaacgagatgggcctcctggagaccacgaagcgggacctgggggtgtccaaggagcccggcgtggtcagccccacctcctacctcgacgtggacctgcacccggccagcgcctggaccctgtacgccgtggcgaccacggtcatcgcccccatgctccgccacaccatcgagaactccaccgccaacgtgagcatggccgccatcgcgaaccaggccgtggtcctgatggggctggacaagggctggcccatctccaagatggacctcggcgtgcccctgctggccctcgggtgctacttctacgtgaacccgctgaccctgacggccgccgtcttcctcctggtgacccactacgcgatcatcggccccgggctgcaggccaaggccacccgggaggcccacaagaagaccgccgcgggcatcatgaacccgccgcccggcgacgggatcatgacgatcgacctcgaccccgtgatctacgacagcaagttcgagaagcagctgggccaggtcatgctgctcgtgctgtgcgccgtgcagctgctcctgatgcgcacctcctgggccctgtgcgaggccctcaccctggcgaccgggcccacgaccaccctgtgggagggcagccccgggaagttctggaacaccacgatcgccgtcagcatggccaacatcttccggggctcctacctcgccggcgccgggctggcgttcagcatcatgaagtccgtgggcaccgggaagcgcggcaccgggagccagggcgagaccctgggcgagaagtggaagaagaagctcaaccagctgtcccggaaggagttcgacctgtacaagaagtccgggatcaccgaggtggaccgcacggaggccaaggagggcctcaagcgcggggagatcacccaccacgccgtctcccgcggcagcgccaagctgcagtggttcgtggagcggaacatggtgatccccgaggggcgcgtcatcgacctgggctgcggcaagggcgggtggtcctactactgcgccgggctcaagaaggtgaccgaggtgcggggctacaccaagggcgggcccggccacgaggagcccgtccccatgagcacgtacgggtggaacatcgtgaagctgatgtccggcaaggacgtgttctacctgccgcccgagaagtgcgacaccctcctgtgcgacatcggggagagctcccccagccccaccgtcgaggagtcccgcaccatccgcgtgctgaagatggtggagccgtggctcaagaacaaccagttctgcatcaaggtcctgaacccctacatgcccacggtgatcgagcacctggagcggctgcagcgcaagcacggcggcatgctcgtgcggaaccccctgagccgcaactcccggaacgagatgtactggatcagcaacgggaccggcaacatcgtctccagcgtgaacatggtgagccgcctgctcctgaaccggttcaccatgacccaccgccggccgacgatcgagaaggacgtcgacctgggggcgggcacccgccacgtgaacgccgagcccgagacccccaacatggacgtgatcggggagcggatcaagcgcatcaaggaggagcacaactccacctggcactacgacgacgagaacccgtacaagacgtgggcctaccacggcagctacgaggtcaaggccaccggctccgccagctccatgatcaacggggtggtcaagctcctgaccaagccctgggacgtggtgcccatggtcacccagatggcgatgacggacaccacccccttcggccagcagcgggtgttcaaggagaaggtggacacccgcacgccgcggctgatgccccgcacccggaaggtcatggagatcaccgccgagtggctctggcgcaccctggggcggaacaagcgcccccgcctgtgcacgcgggaggagttcaccaagaaggtgcgccccatcgccgccatgggcgcggtgttcacccagcgggaccagtgggacagcgccaaggccgccgtcgaggacgaggagttctggaagccggtggaccgcgagtgcaactcccaccagctcgggaagtgcggcagctgcgtgtacaacatgatgggcaagcgggagaagaagctgggggagttcggcaaggccaaggggtcccgcgcgatctggtacatgtggctgggcgcccggtacctcgagttcgaggccctggggttcctgaacgaggaccactggttcagccgcgagaactcctacagcggcgtcgagggcgaggggctccacaagctgggctacatcctgcgggacatctccaagatccccgggggcgccatgtacgccgacgacaccgcgggctgggacacgcgcaacaccgaggacgacctccacatgaaggagaagatcacccagcagatggggcccggccacagccggctggccaacgccatcttcaagctgacctaccagaacaaggtggtgaaggtccagcgccccacgccgaccgggaccgtgatggacatcatctcccggaaggaccagcgcggcagcggccaggtgggcacctacggcctcaacaccttcacgaacatggaggcccagctggtccggcagatggagggggagggcgtgctgtccaaggccgacctcgagaacccccacctcctggagaagaagatcacccagtggctcgagaccaagggggtggagcgcctgaagcggatggcgatcagcggcgacgactgcgtcgtgaagcccatcgacgaccgcttcgccaacgccctgctcgccctgaacgacatggggaaggtgcggaaggacatcccccagtggcagccgtccaagggctggcacgactggcagcaggtccccttctgcagccaccacttccacgagctgatcatgaaggacggccgcaagctcgtggtgccctgccggccccaggacgagctgatcgggcgcgcccgcatcagccagggcgcggggtggtccctgcgggagaccgcctgcctcggcaaggcctacgcccagatgtggagcctgatgtacttccaccgccgggacctgcgcctcgcgtccaacgccatctgcagcgccgtcccggtgcactgggtgcccacgtcccggaccacctggagcatccacgcccaccaccagtggatgaccacggaggacatgctgaccgtctggaaccgcgtgtggatcgaggacaacccctggatggaggacaagacccccgtgaccacgtgggagaacgtcccgtacctggggaagcgggaggaccagtggtgcggctccctcatcggcctgaccagccgcgccacctgggcgcagaacatccccaccgccatccagcaggtccggtccctgatcgggaacgaggagttcctcgactacatgcccagcatgaagcgcttccggaaggaggaggagtccgagggcgccatctggtga

SEQ ID NO: 9927 - RNA, 9873 nt, synthetic construct
  misc_feature 1..9873: note = derived and/or modified CDS sequence (opt1) from DENV-3__GU131903__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagcacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcactccggccgcctgatcaccgccaaccccgtggtcacgaagaaggaggagcccgtgaacatcgaggccgagccgcccttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccaacgccagccgggcctggaacgtgtgggaggtcgaggactacgggttcggcgtgttcacgaccaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcacgttcgtcctcctgctgagcggccagatcacctggcgcgacatggcgcacaccctcatcatgatcggctccaacgccagcgaccggatggggatgggcgtgacctacctggccctgatcgccacgttcaagatccagcccttcctcgccctggggttcttcctgcgcaagctcaccagccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtctccctgacgtgcagcaacaccatcttcaccctgaccgtggcctggcgcacggccaccctcatcctggccggggtctccctgctcccgctgtgccagagctccagcatgcggaagaccgactggctgcccatgaccgtggccgcgatgggcgtgccgcccctgccgctgttcatcttctccctgaaggacacgcccaagcgccgcagctggcccctcaacgagggggtcatggccgtgggcctggtgtccatcctggccagctccctcctgcggaacgacgtccccatggccggcccgctggtggccgggggcctcctgatcgcgtgctacgtgatcaccgggaccagcgccgacctgaccgtcgagaaggccgccgacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgcgctgctgatcgtgagcggcatcttcccctactccatccccgccaccctcctggtctggcacacctggcagaagcagacgcagcggagcggcgtgctgtgggacgtgccctccccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggccagcgtgaagaaggacctcatctcctacggcgggggctggcggctgaacgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggcagcccgatcatcaaccgcgagggcaaggtggtcgggctgtacggcaacggggtggtgaccaagaacggcgggtacgtctccggcatcgcgcagacgaacgccgagcccgacggccccacccccgagctcgaggaggagatgttcaagaagcggaacctgaccatcatggacctgcacccggggagcggcaagacccgcaagtacctccccgccatcgtgcgggaggccatcaagcgccggctgcgcacgctgatcctcgcccccacccgggtggtcgcggccgagatggaggaggccctgaaggggctgcccatccgctaccagaccaccgccacgaagtccgagcacaccggccgggagatcgtggacctcatgtgccacgccaccttcaccatgcgcctgctgagcccggtgcgggtccccaactacaacctcgtgatcatggacgaggcgcacttcacggaccccgcctccatcgccgcccgcgggtacatcagcacccgggtgggcatgggcgaggccgcggccatcttcatgaccgccacgccgcccgggacggccgaggcgttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgccaactgcctgcggaagaacgggaagaaggtcatccagctgtcccgcaagaccttcgacacggagtaccagaagacccggctcaacgactgggacttcgtggtgaccaccgacatcagcgagatgggcgccaacttcaaggcggaccgcgtcatcgacccccggcgctgcctgaagcccgtgatcctgacggacggccccgagcgggtgatcctcgccgggccgatgcccgtcaccgccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagacgttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcccggacctactccgaccccctcgcgctgaaggagttcaaggacttcgccgccggccgcaagagcatcgccctggacctcgtgacggagatcgggcgggtgccctcccacctggcccaccgcacccggaacgcgctggacaacctcgtcatgctgcacaccagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtgatcgtcagctccggcatgctgtggatggccgacgtgcccctgcagtggatcgcgagcgccatcgtgctcgagttcttcatgatggtcctgctgatccccgagcccgagaagcagcgcaccccgcaggacaaccagctcgcctacgtggtgatcgggatcctgacgctggccgccatcgtcgcggccaacgagatgggcctcctggagaccaccaagcgggacctgggcatgtccaaggagcccggggtggtgagccccacctcctacctcgacgtcgacctgcaccccgccagcgcctggacgctgtacgccgtggcgaccaccgtgatcaccccgatgctccgccacacgatcgagaactccaccgccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacgcactacgcgatcatcggcccgggcctgcaggccaaggccacccgggaggcccagaagcgcaccgccgcggggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgccaccggccccatcacgaccctgtgggagggctccccggggaagttctggaacaccaccatcgcggtcagcatggccaacatcttccgcggctcctacctggccggggccggcctcgcgttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtcagccgcggctccgccaagctccagtggttcgtggagcggaacatggtgatccccgaggggcgcgtcatcgacctgggctgcgggcgcggcgggtggagctactactgcgccggcctgaagaaggtgaccgaggtgcggggctacaccaaggcggggcccggccacgaggagcccgtcccgatgtccacgtacgggtggaacatcgtgaagctcatgagcggcaaggacgtgttctacctgccgcccgagaagtgcgacaccctgctgtgcgacatcggggagtccagcccctccccgaccgtcgaggagagccgcaccatccgggtgctcaagatggtggagccctggctgcgcaacaaccagttctgcatcaaggtcctgaacccctacatggccacgggcatcgagcacctcgagcggctgcagcgcaagtacggcgggatgctggtgcggaaccccctctcccgcaacagcacccacgagatggactggatctccaacggcaccgggaacatcgtgagctccgtcaacatggtgagccggctgctgctcaaccgcttcaccatgacgcaccggcgcccgaccatcgagaaggacgtcgacctgggcgccggcacccggcacgtgaacgccgagcccgagacccccaacatggacgtgatcggggagcgcatcaagcggatcaaggaggagcactccagcacgtggcactacgacgacgagaacccgtacaagacctgggcctaccacggctcctacgaggtcaaggcgaccgggagcgccagctccatgatcaacggcgtggtgaagctgctcaccaagccctgggacgtcgtgcccatggtgacgcagatggccatgaccgacaccacccccttcgggcagcagcgcgtcttcaaggagaaggtggacacgcggaccccgcgccccatgcccggcacccggaaggtgatggagatcaccgccgagtggctgtggcgcacgctgggccgcaacaagaagccccggctctgcacccgcgaggagttcaccaagaaggtccggaccaacgccgcgatgggggccgtgttcacggaggagaaccagtgggacagcgcccgcgccgcggtggaggacgaggagttctggaagctggtcgaccgggagcgcgagctgcacaagctcggcaagtgcgggtcctgcgtgtacaacatgatgggcaagcgggagaagaagctgggggagttcggcaaggccaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatcccgggcggggcgatgtacgccgacgacaccgccggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccacccccaaggggaccgtcatggacatcatctcccggaaggaccagcgcggcagcggccaggtggggacctacggcctcaacacgttcaccaacatggaggcgcagctggtgcggcagatggagggggagggcgtcctgtccaaggccgacctcgagaacccgcacctcctggagaagaagatcacccagtggctcgagaccaagggggtggagcgcctgaagcggatggccatcagcggcgacgactgcgtggtcaagcccatcgacgaccgcttcgccaacgccctgctcgcgctgaacgacatgggcaaggtgcggaaggacatcccccagtggcagccctccaaggggtggcacgactggcagcaggtcccgttctgcagccaccacttccacgagctgatcatgaaggacggccgcaagctcgtcgtgccctgccgcccccaggacgagctgatcgggcgggcccgcatctcccagggcgccgggtggagcctgaaggagacggcctgcctcggcaaggcctacgcgcagatgtggtccctgatgtacttccaccggcgcgacctgcggctcgccagcaacgccatctgctccgccgtgcccgtccactggatcccgaccagccgcaccacctggagcatccacgcgcaccaccagtggatgacgaccgaggacatgctgaccgtgtggaaccgggtgtggatcgaggacaacccctggatggaggacaagacccccgtcacgacctgggaggacgtgccctacctgggcaagcgcgaggaccagtggtgcgggtccctcatcggcctgaccagccgggccacctgggcccagaacatcctgacggccatccagcaggtccgctccctcatcggggacgaggagttcctggactacatgccgagcatgaagcggttccgcaaggaggaggagtccgagggcgccatctggtga

SEQ ID NO: 9928 - RNA, 9873 nt, synthetic construct
  misc_feature 1..9873: note = derived and/or modified CDS sequence (opt1) from DENV-3__GU131904__SS-prME
  source 1..9873: mol_type = other RNA
accagcctgtgcctcatgatgatgctgcccgccaccctggccttccacctcaccagccgggacggggagccgcggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacagcatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgccagccgggcctggaacgtgtgggaggtcgaggactacgggttcggcgtgttcacgaccaacatctggctgaagctccgcgaggtgtacacccagtcctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtcgtgatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcacgttcgtcctcctgctgtccggccagatcacctggcgcgacatggcgcacaccctcatcatgatcggcagcaacgccagcgaccggatggggatgggcgtgacctacctggccctgatcgccacgttcaagatccagcccttcctcgccctggggttcttcctgcgcaagctcacctcccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtcagcctgacgtgctccaacaccatcttcaccctgaccgtggcctggcgcacggccaccctcatcctggccggggtcagcctgctcccgctgtgccagtccagctccatgcggaagaccgactggctgcccatgaccgtggccgcgatgggcgtgccgcccctgccgctgttcatcttcagcctgaaggacacgcccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcaccgggacctccgccgacctgaccgtcgagaaggccgccgacgtgacgtgggaggaggaggccgagcagaccggcgtgagccacaacctcatgatcaccgtcgacgacgacgggaccatgcgcatcaaggacgacgagaccgagaacatcctgacggtgctgctcaagaccgcgctgctgatcgtgtccggcatcttcccctacagcatccccgccaccctcctggtctggcacacctggcagaagcagacgcagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggcctccgtgaagaaggacctcatcagctacggcgggggctggcggctgagcgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggacctccggcagcccgatcatcaaccgcgagggcaaggtggtcgggctgtacggcaacggggtggtgaccaagaacggcgggtacgtctccggcatcgcgcagacgaacgccgagcccgacggccccacccccgagctcgaggaggagatgttcaagaagcggaacctgaccatcatggacctgcacccggggagcggcaagacccgcaagtacctccccgccatcgtgcgggaggccatcaagcgccggctgcgcacgctgatcctcgcccccacccgggtggtcgcggccgagatggaggaggccctgaaggggctgcccatccgctaccagaccaccgccacgaagtccgagcacaccggccgggagatcgtggacctcatgtgccacgccaccttcaccatgcgcctgctgagcccggtgcgggtccccaactacaacctcgtgatcatggacgaggcgcacttcacggaccccgcctccatcgccgcccgcgggtacatcagcacccgggtgggcatgggcgaggccgcggccatcttcatgaccgccacgccgcccgggacggccgaggcgttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgccaactgcctgcggaagaacgggaagaaggtcatccagctgtcccgcaagaccttcgacacggagtaccagaagacccggctcaacgactgggacttcgtggtgaccaccgacatcagcgagatgggcgccaacttcaaggcggaccgcgtcatcgacccccggcgctgcctgaagcccgtgatcctgacggacggccccgagcgggtgatcctcgccgggccgatgcccgtcaccgccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagacgttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcccggacctactccgaccccctcgcgctgaaggagttcaaggacttcgccgccggccgcaagagcatcgccctggacctcgtgacggagatcgggcgggtgcccagccacctggcccaccgcacccggaacgcgctggacaacctcgtcatgctgcacacctccgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtgatcgccagctccggcatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcgggatcctgacgctggccgcgatcgtggccgccaacgagatgggcctcctggagaccaccaagcgggacctgggcatgtccaaggagcccggggtcgtgagccccacctcctacctcgacgtggacctgcaccccgccagcgcctggacgctgtacgcggtcgccaccaccgtgatcaccccgatgctccgccacacgatcgagaactccaccgccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacgcactacgccatcatcggcccgggcctgcaggccaaggccacccgggaggcccagaagcgcaccgcggccgggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggccctgaccctcgcgaccggccccatcacgaccctgtgggagggctccccggggaagttctggaacaccaccatcgccgtgagcatggccaacatcttccgcggctcctacctggccggggcgggcctcgccttcagcatcatgaagtccgtcgggacgggccggcgcggcaccgggtcccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtgagccgcggctccgccaagctccagtggttcgtcgagcggaacatggtgatccccgaggggcgcgtgatcgacctgggctgcgggcgcggcgggtggagctactactgcgcgggcctgcggaaggtcaccgaggtgcgcggctacaccaagggcgggcccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccggaccatccgcgtcctcaagatggtggagccctggctgcggaacaaccagttctgcatcaaggtgctgaacccctacatgcccacggtcatcgagcacctcgagcgcctgcagcggaagtacggcgggatgctggtgcgcaacccgctctcccggaacagcacccacgagatgtactggatctccaacggcaccgggaacatcgtgagctccgtcaacatggtgagccgcctgctgctcaaccggttcaccatgacgcaccgccggcccaccatcgagaaggacgtcgacctgggcgccggcacccgccacgtgaacgccgagcccgagaccccgaacatggacgtgatcggggagcggatcaagcgcatcaaggaggagcactccagcacgtggcactacgacgacgagaacccctacaagacctgggcctaccacggcagctacgaggtcaaggccaccgggtccgcgagctccatgatcaacggcgtggtgaagctgctcaccaagccctgggacgtcgtgcccatggtgacgcagatggccatgaccgacaccaccccgttcgggcagcagcgggtcttcaaggagaaggtggacacgcgcacgccccggcccatggccggcacccgcaaggtgatggagatcaccgccgagtggctgtggcgcacgctgggccggaacaagaagccccgcctctgcacccgggaggagttcaccaagaaggtccgcaccaacgccgcgatgggggccgtgttcacggaggagaaccagtgggacagcgcccgggccgcggtggaggacgaggagttctggaagctggtcgaccgcgagcgggagctgcacaagctcggcaagtgcgggtcctgcgtgtacaacatgatgggcaagcgcgagaagaagctgggggagttcggcaaggccaagggcagccgggccatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatcccgggcggggcgatgtacgccgacgacaccgccggctgggacacccggatcaccgaggacgacctccacaacgaggagaagatcacgcagcagatggaccccgagcaccgccagctggccaacgccatcttcaagctgacctaccagaacaaggtcgtgaaggtgcagcggcccacccccaaggggaccgtcatggacatcatctcccgcaaggaccagcggggcagcggccaggtggggacctacggcctcaacacgttcaccaacatggaggcgcagctggtgcgccagatggagggggagggcgtcctgtccaaggccgacctcgagaacccgcacctcctggagaagaagatcacccagtggctcgagaccaagggggtggagcggctgaagcgcatggccatcagcggcgacgactgcgtggtcaagcccatcgacgaccggttcgccaacgccctgctcgcgctgaacgacatgggcaaggtgcgcaaggacatcccccagtggcagccctccaaggggtggcacgactggcagcaggtcccgttctgcagccaccacttccacgagctgatcatgaaggacggccgcaagctcgtcgtgccctgccggccccaggacgagctgatcgggcgcgcccggatctcccagggcgccgggtggagcctgaaggagacggcctgcctcggcaaggcctacgcgcagatgtggtccctgatgtacttccaccgccgggacctgcgcctcgccagcaacgccatctgcagcgccgtgcccgtccactggatcccgacctcccggaccacctggagcatccacgcgcaccaccagtggatgacgaccgaggacatgctgaccgtgtggaaccgcgtgtggatcgaggacaacccctggatggaggacaagacccccgtcacgacctgggaggacgtgccctacctgggcaagcgggaggaccagtggtgcgggtccctcatcggcctgaccagccgcgccacctgggcccagaacatcctgacggccatccagcaggtccggtccctcatcggggacgaggagttcctggactacatgccgagcatgaagcgcttccggaaggaggaggagtccgagggcgccatctggtga

SEQ ID NO: 9929 - RNA, 9873 nt, synthetic construct
  misc_feature 1..9873: note = derived and/or modified CDS sequence (opt1) from DENV-3__GU131906__SS-prME
  source 1..9873: mol_type = other RNA
accagcctgtgcctcatgatgatgctgcccgccaccctggccttccacctcaccagccgggacggggagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggcgaagatcgtgaccgccgagacccagaactccagcttcatcatcgacggccccaacacccccgagtgcccctccgccagccgggcctggaacgtgtgggaggtcgaggactacgggttcggcgtgttcacgaccaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcacgttcgtcctcctgctgagcggccagatcacctggcgcgacatggcgcacaccctcatcatgatcggctccaacgccagcgaccggatggggatgggcgtgacctacctggccctgatcgccacgttcaagatccagcccttcctcgccctggggttcttcctgcgcaagctcaccagccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtctccctgacgtgcagcaacaccatcttcaccctgaccgtggcctggcgcacggccaccctcatcctggccggggtctccctgctcccgctgtgccagagctccagcatgcggaagaccgactggctgcccatgaccgtggccgcgatgggcgtgccgcccctgccgctgttcatcttctccctgaaggacacgccccgccgccggagctggcccctcaacgagggggtcatggccgtgggcctggtgtccatcctggccagctccctcctgcgcaacgacgtccccatggccggcccgctggtggccgggggcctcctgatcgcgtgctacgtgatcaccgggaccagcgccgacctgaccgtcgagaaggccgccgacgtgacgtgggaggaggaggccgagcagaccggcgtgtcccacaacctcatgatcaccgtcgacgacgacgggaccatgcggatcaaggacgacgagaccgagaacatcctgacggtgctgctcaagaccgcgctgctgatcgtgagcggcatcttcccctactccatccccgccaccctcctggtctggcacacctggcagaagcagacgcagcgcagcggcgtgctgtgggacgtgccctccccgcccgagacccagaaggccgagctcgaggagggggtctaccggatcaagcagcagggcatcttcgggaagacccaggtgggcgtgggggtccagaaggagggcgtgttccacaccatgtggcacgtgacgcgcggcgccgtcctgacccacaacgggaagcggctggagcccaactgggccagcgtgaagaaggacctcatctcctacggcgggggctggcgcctgagcgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggctccccgatcatcaaccgggagggcaaggtggtcgggctgtacggcaacggggtggtgaccaagaacggcgggtacgtcagcggcatcgcgcagacgaacgccgagcccgacggccccacccccgagctcgaggaggagatgttcaagaagcgcaacctgaccatcatggacctgcacccggggtccggcaagacccggaagtacctccccgccatcgtgcgcgaggccatcaagcggcgcctgcggacgctgatcctcgcccccacccgcgtggtcgcggccgagatggaggaggccctgaaggggctgcccatccggtaccagaccaccgccaccaagagcgagcacaccggccgcgagatcgtggacctcatgtgccacgccaccttcaccatgcggctgctgtccccggtgcgcgtccccaactacaacctcgtgatcatggacgaggcgcacttcacggaccccgccagcatcgccgcccgggggtacatctccacccgcgtgggcatgggcgaggccgcggccatcttcatgaccgccacgccgcccgggacggccgaggcgttcccccagagcaacgcccccatccaggacgaggagcgcgacatccccgagcggtcctggaacagcggcaacgagtggatcaccgacttcgtcgggaagaccgtgtggttcgtgccctccatcaaggccggcaacgacatcgccaactgcctgcgcaagaacgggaagaaggtcatccagctgagccggaagaccttcgacacggagtaccagaagacccgcctcaacgactgggacttcgtggtgaccaccgacatctccgagatgggcgccaacttcaaggcggaccgggtcatcgacccccgccggtgcctgaagcccgtgatcctgacggacggccccgagcgcgtgatcctcgccgggccgatgcccgtcaccgccgccagcgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagagccggaagacgttcgtcgagctcatgcgccgcggggacctgcccgtgtggctggcccacaaggtggcctccgagggcatcaagtacaccgaccgcaagtggtgcttcgacggggagcggaacaaccagatcctcgaggagaacatggacgtcgagatctggaccaaggagggcgagcgcaagaagctgcgcccgcggtggctggacgcccgcacctacagcgaccccctcgcgctgaaggagttcaaggacttcgccgccggccggaagtccatcgccctggacctcgtgacggagatcgggcgcgtgcccagccacctggcccaccggacccgcaacgcgctggacaacctcgtcatgctgcacaccagcgagcacggcgggcgggcctaccgccacgccgtggaggagctgccggagaccatggagacgctcctgctgctcggcctgatgatcctgctcaccgggggcgccatgctgttcctgatctccggcaaggggatcggcaagaccagcatcgggctcatctgcgtgatcgcctccagcggcatgctgtggatggcggacgtccccctgcagtggatcgcctccgccatcgtgctcgagttcttcatgatggtgctgctgatccccgagcccgagaagcagcggaccccgcaggacaaccagctcgcctacgtcgtgatcgggatcctgacgctggccgcgatcgtggccgccaacgagatgggcctcctggagaccaccaagcgcgacctgggcatgagcaaggagcccggggtcgtgtcccccaccagctacctcgacgtggacctgcaccccgcctccgcctggacgctgtacgcggtcgccaccaccgtgatcaccccgatgctccggcacacgatcgagaacagcaccgccaacgtgtccctggccgcgatcgccaaccaggccgtcgtgctgatgggcctcgacaaggggtggcccatcagcaagatggacctgggcgtgcccctgctcgccctggggtgctactcccaggtcaaccccctgaccctcaccgccgcggtgctgctgctcgtgacgcactacgccatcatcggcccgggcctgcaggccaaggccacccgcgaggcccagaagcggaccgcggccgggatcatgaagaaccccaccgtcgacggcatcatgacgatcgacctggaccccgtgatctacgacagcaagttcgagaagcagctcggccaggtgatgctgctggtcctctgcgccgtgcagctgctgctcatgcgcacctcctgggccctgtgcgaggccctgaccctcgcgaccggccccatcacgaccctgtgggagggcagcccggggaagttctggaacaccaccatcgccgtgtccatggccaacatcttccggggcagctacctggccggggcgggcctcgccttctccatcatgaagtccgtcgggacgggccgccggggcaccgggagccagggcgagaccctgggggagaagtggaagaagaagctgaaccagctctcccgcaaggagttcgacctgtacaagaagtccggcatcaccgaggtggaccggaccgaggccaaggaggggctgaagcgcggcgagacgacccaccacgccgtgtcccggggcagcgccaagctccagtggttcgtcgagcgcaacatggtgatccccgaggggcgcgtgatcgacctgggctgcgggcggggcgggtggtcctactactgcgcgggcctgaagaaggtcaccgaggtgcgcggctacaccaagggcgggcccgggcacgaggagcccgtgccgatgagcacgtacggctggaacatcgtcaagctcatgtccgggaaggacgtgttctacctgccgcccgagaagtgcgacaccctgctgtgcgacatcggcgagagctcccccagcccgaccgtggaggagtcccggaccatccgcgtcctcaagatggtggagccctggctgcggaacaaccagttctgcatcaaggtgctgaacccctacatgcccacggtcatcgagcacctcgagcgcctgcagcggaagtacggcgggatgctggtgcgcaacccgctcagccggaactccacccacgagatgtactggatcagcaacggcaccgggaacatcgtgtccagcgtcaacatggtgtcccgcctgctgctcaaccggttcaccatgacgcaccgccggcccaccatcgagaaggacgtcgacctgggcgccggcacccgccacgtgaacgccgagcccgagaccccgaacatggacgtgatcggggagcggatcaagcgcatcaaggaggagcacagctccacgtggcactacgacgacgagaacccctacaagacctgggcctaccacggcagctacgaggtcaaggccaccgggagcgcgtccagcatgatcaacggcgtggtgaagctgctcaccaagccctgggacgtcgtgcccatggtgacgcagatggccatgaccgacaccaccccgttcgggcagcagcgggtcttcaaggagaaggtggacacgcgcacgccccggcccatgcccggcacccgcaaggtgatggagatcaccgccgagtggctgtggcgcacgctgggccggaacaagaagccgcgcctctgcacccgggaggagttcaccaagaaggtccgcaccaacgccgccatgggggcggtgttcacggaggagaaccagtgggactccgcccgggccgccgtggaggacgaggagttctggaagctggtcgaccgcgagcgggagctgcacaagctcggcaagtgcgggagctgcgtgtacaacatgatgggcaagcgcgagaagaagctgggggagttcggcaaggcgaagggctcccgggccatctggtacatgtggctgggggcccgctacctcgagttcgaggccctgggcttcctgaacgaggaccactggttcagccgggagaactcctacagcggggtggagggcgaggggctccacaagctgggctacatcctgcgcgacatctccaagatccccggcggggccatgtacgcggacgacaccgccggctgggacacccggatcaccgaggacgacctccacaacgaggagaagatcacgcagcagatggaccccgagcaccgccagctggccaacgccatcttcaagctgacctaccagaacaaggtcgtgaaggtgcagcggcccaccccgaaggggaccgtcatggacatcatcagccgcaaggaccagcggggctccggccaggtggggacctacggcctcaacacgttcaccaacatggaggcccagctggtgcgccagatggagggggagggcgtcctgagcaaggcggacctcgagaacccccacctcctggggaagaagatcacccagtggctcgagaccaagggcgtggagcggctgaagcgcatggccatctccggcgacgactgcgtggtcaagcccatcgacgaccggttcgccaacgccctgctcgccctgaacgacatggggaaggtgcgcaaggacatcccccagtggcagccgagcaagggctggcacgactggcagcaggtccccttctgctcccaccacttccacgagctgatcatgaaggacgggcgcaagctcgtcgtgccctgccggccccaggacgagctgatcggccgcgcgcggatcagccagggggccggctggtccctgaaggagacggcctgcctcggcaaggcctacgcccagatgtggagcctgatgtacttccaccgccgggacctgcgcctcgcgtccaacgccatctgcagcgccgtgccggtccactggatccccaccagccggaccacctggtccatccacgcccaccaccagtggatgacgaccgaggacatgctgaccgtgtggaaccgcgtgtggatcgaggacaacccctggatggaggacaagacccccgtcacgacctgggaggacgtgccgtacctggggaagcgggaggaccagtggtgcggcagcctcatcgggctgacctcccgcgcgacctgggcccagaacatcctgacggccatccagcaggtccggagcctcatcggcgacgaggagttcctggactacatgccctccatgaagcgcttccggaaggaggaggagagcgagggggccatctggtga

SEQ ID NO: 9930 - RNA, 9873 nt, synthetic construct
  misc_feature 1..9873: note = derived and/or modified CDS sequence (opt1) from DENV-3__GU131907__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgcctcccgggcctggaacgtgtgggaggtcgaggactacgggttcggcgtgttcacgaccaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtcgtgatcgccgagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcaccttcgtcctcctgctgtccggccagatcacgtggcgcgacatggcccacaccctcatcatgatcggcagcaacgcctccgaccggatggggatgggcgtgacctacctggccctgaccgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtcagcctgacgtgctccaacaccatcttcaccctgaccgtggcctggcgcacggccaccctcatcctggccggggtcagcctgctcccgctgtgccagtccagctccatgcggaagaccgactggctgcccatgaccgtggcggccatgggcgtgccgcccctgccgctgttcatcttcagcctgaaggacacgcccaagcgccgctcctggcccctcaacgagggggtcatggccgtgggcctggtgagcatcctggcctccagcctcctgcggaacgacgtccccatggccggcccgctggtggccggcgggctcctgatcgcctgctacgtgatcaccgggacctccgccgacctgaccgtcgagaaggccgccgacgtgacgtgggaggaggaggcggagcagaccggggtgagccacaacctcatgatcaccgtcgacgacgacgggaccatgcgcatcaaggacgacgagaccgagaacatcctgacggtgctgctcaagaccgccctgctgatcgtgtccggcatcttcccctacagcatccccgccaccctcctggtctggcacacctggcagaagcagacgcagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggcgtccgtgaagaaggacctcatcagctacggcgggggctggcggctgtccgcccagtggcagaagggggaggaggtgcaggtcatcgccgtggagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtcgggctgtacggcaacggggtggtgaccaagaacggcgggtacgtctccggcatcgcccagacgaacgccgagcccgacggccccacccccgagctcgaggaggagatgttcaagaagcggaacctgaccatcatggacctgcacccggggagcggcaagacccgcaagtacctccccgccatcgtgcgggaggccatcaagcgccggctgcgcacgctgatcctcgcgcccacccgggtggtcgccgccgagatggaggaggccctgaaggggctgcccatccgctaccagaccaccgccacgaagtccgagcacaccggccgggagatcgtggacctcatgtgccacgcgaccttcaccatgcgcctgctgagcccggtgcgggtccccaactacaacctcgtgatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgccaactgcctgcggaagaacgggaagaaggtcatccagctgtcccgcaagaccttcgacacggagtaccagaagacccggctcaacgactgggacttcgtggtgaccaccgacatcagcgagatgggcgcgaacttcaaggccgaccgcgtcatcgacccccggcgctgcctgaagcccgtgatcctgacggacggccccgagcgggtgatcctcgccgggccgatgcccgtcaccgccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgacggagatcgggcgggtgccctcccacctggcgcaccgcacccggaacgccctggacaacctcgtcatgctgcacaccagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgacgctggccgcgatcgtcgccgccaacgagatgggcctcctggagaccaccaagcgggacctgggcatgtccaaggagcccggggtggtgagccccacctcctacctcgacgtcgacctgcaccccgccagcgcctggacgctgtacgcggtggccaccaccgtgatcaccccgatgctccgccacacgatcgagaactccaccgccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacgcactacgccatcatcggcccgggcctgcaggccaaggccacccgggaggcccagaagcgcaccgcggccgggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgcgaccggccccatcacgaccctgtgggagggctccccggggaagttctggaacaccaccatcgccgtcagcatggccaacatcttccgcggctcctacctggccggggcgggcctcgccttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacgtacggctggaacatcgtgaagctcatgagcgggaaggacgtgttctacctgccgcccgagaagtgcgacaccctgctgtgcgacatcggcgagtccagcccctccccgaccgtcgaggagagccgcaccatccgggtgctcaagatggtggagccctggctgcgcaacaaccagttctgcatcaaggtcctgaacccctacatgcccacggtgatcgagcacctcgagcggctgcagcgcaagtacggcgggatgctggtgcggaacccgctctcccgcaacagcacccacgagatgtactggatctccaacggcaccgggaacatcgtcagctccgtgaacatggtcagccggctgctgctcaaccgcttcaccatgacgcaccggcgccccaccatcgagaaggacgtggacctgggcgccggcacccggcacgtgaacgccgagcccgagaccccgaacatggacgtcatcggggagcgcatcaagcggatcaaggaggagcactccagcacgtggcactacgacgacgagaacccctacaagacctgggcctaccacggctcctacgaggtgaaggccaccgggagcgcgagctccatgatcaacggcgtggtcaagctgctcaccaagccctgggacgtggtgcccatggtcacgcagatggccatgaccgacaccaccccgttcgggcagcagcgcgtgttcaaggagaaggtggacacgcggacgccccggcccatgcccggcacccggaaggtcatggagatcaccgccgagtggctgtggcgcacgctgggccgcaacaagaagccgcggctctgcacccgcgaggagttcaccaagaaggtgcggaccaacgccgccatgggggcggtgttcacggaggagaaccagtgggacagcgcccgcgccgccgtcgaggacgaggagttctggaagctggtggacaaggagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgcggacgacaccgccggctgggacacccggatcaccgaggacgacctccacaacgaggagaagatcacgcagcagatggaccccgagcaccgccagctggccaacgccatcttcaagctgacctaccagaacaaggtggtgaaggtccagcggcccaccccgaaggggaccgtgatggacatcatctcccgcaaggaccagcggggcagcggccaggtggggacctacggcctcaacacgttcaccaacatggaggcccagctggtccgccagatggagggggagggcgtgctgtccaaggcggacctcgagaacccccacctcctggagaagaagatcacccagtggctcgagaccaagggggtggagcggctgaagcgcatggccatcagcggcgacgactgcgtcgtgaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtggtgccctgccgcccccaggacgagctgatcgggcgcgcgcggatctcccagggcgccgggtggagcctgaaggagacggcctgcctcggcaaggcctacgcccagatgtggtccctgatgtacttccaccgccgggacctgcgcctcgcgagcaacgccatctgctccgccgtcccggtgcactggatccccaccagccggaccacctggagcatccacgcccaccaccagtggatgacgaccgaggacatgctgaccgtgtggaaccgcgtctggatcgaggacaacccctggatggaggacaagacccccgtgacgacctgggaggacgtgccgtacctgggcaagcgggaggaccagtggtgcgggtccctcatcggcctgaccagccgcgcgacctgggcccagaacatcctgacggccatccagcaggtccggtccctcatcggggacgaggagttcctggactacatgcccagcatgaagcgcttccggaaggaggaggagaccgagggcgccatctggtga

SEQ ID NO: 9931 - RNA, 9873 nt, synthetic construct
  misc_feature 1..9873: note = derived and/or modified CDS sequence (opt1) from DENV-3__GQ868634__SS-prME
  source 1..9873: mol_type = other RNA
accagcctgtgcctcatgatgatgctgcccgcgaccctggccttccacctcaccagccgcgacggcgagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgccatcaactggaagggcaaggagctgaagtgcggctccgggatcttcgtgaccaacgaggtccacacgtggaccgagcagtacaagttccaggcggacagccccaagcgcctggccaccgccatcgccggcgcctgggagaacggggtgtgcggcatccgctccaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggccaagatcgtcaccgccgagacccagaactccagcttcatcatcgacggccccaacacccccgagtgcccctccgccagccgggcgtggaacgtgtgggaggtggaggactacgggttcggcgtcttcacgaccaacatctggctgaagctccgcgaggtgtacacccagagctgcgaccaccggctgatgtccgccgccatcaaggacgagcgcgccgtgcacgccgacatgggctactggatcgagagccagaagaacgggtcctggaagctggagaaggcgagcttcatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtgaagtccctggtcagcgccggctccgggaaggtggacaacttcaccatgggcgtgctgtgcctcgccatcctgttcgaggaggtcatgcgggggaagttcggcaagaagcacatgatcgcgggggtgctgttcacgttcgtgctcctgctgagcggccagatcacctggcgcgacatggcccacaccctcatcatgatcggctccaacgccagcgaccggatggggatgggcgtcacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgtccctgacgtgcagcaacaccatcttcaccctgaccgtcgcctggcgcacggccaccctcatcctggccggggtgtccctgctcccgctgtgccagagctccagcatgcggaagaccgactggctgcccatgaccgtcgcggccatgggcgtgccgcccctgccgctgttcatcttctccctgaaggacacgcccaagcgccgcagctggcccctcaacgagggggtgatggccgtcggcctggtgtccatcctggccagctccctcctgcggaacgacgtgcccatggccggcccgctggtcgccggcgggctcctgatcgcctgctacgtgatcaccgggaccagcgccgacctgaccgtggagaaggccgccgacgtcacgtgggaggaggaggcggagcagaccggggtgtcccacaacctcatgatcaccgtggacgacgacgggaccatgcgcatcaaggacgacgagaccgagaacatcctgacggtcctgctcaagaccgccctgctgatcgtgagcggcatcttcccctactccatccccgccaccctcctggtgtggcacacctggcagaagcagacgcagcggagcggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagcccaactgggcgagcgtcaagaaggacctcatctcctacggcgggggctggcggctgaacgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagacgaacgccgagcccgacggccccacccccgagctcgaggaggagatgttcaagaagcggaacctgaccatcatggacctgcacccggggagcggcaagacccgcaagtacctccccgccatcgtccgggaggccatcaagcgccggctgcgcacgctgatcctcgcgcccacccgggtggtggccgccgagatggaggaggccctgaaggggctgcccatccgctaccagaccaccgccacgaagtccgagcacaccggccgggagatcgtcgacctcatgtgccacgcgaccttcaccatgcgcctgctgagcccggtgcgggtgcccaactacaacctcgtcatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcgcagctggaactccggcaacgagtggatcaccgacttcgtggggaagaccgtctggttcgtgcccagcatcaaggccggcaacgacatcgccaactgcctgcggaagaacgggaagaaggtgatccagctgtcccgcaagaccttcgacacggagtaccagaagacccggctcaacgactgggacttcgtcgtgaccaccgacatcagcgagatgggcgcgaacttcaaggccgaccgcgtgatcgacccccggcgctgcctgaagcccgtcatcctgacggacggccccgagcgggtgatcctcgccgggccgatgcccgtgaccgccgcctccgcggcccagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtggagctcatgcggcgcggggacctgcccgtctggctggcccacaaggtggccagcgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtcacggagatcgggcgggtgccctcccacctggcgcaccgcacccggaacgccctggacaacctcgtgatgctgcacaccagcgagcacggcgggcgcgcctaccggcacgccgtcgaggagctgccggagaccatggagacgctcctgctgctcggcctgatgatcctgctcaccgggggcgccatgctgttcctgatcagcggcaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcgggatcctgacgctggccgcgatcgtggccgccaacgagatgggcctcctggagaccaccaagcgggacctgggcatgtccaaggagcccggggtcgtgagccccacctcctacctcgacgtggacctgcaccccgccagcgcctggacgctgtacgcggtcgccaccaccgtgatcaccccgatgctccgccacacgatcgagaactccaccgccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacgcactacgccatcatcggcccgggcctgcaggccaaggccacccgggaggcccagaagcgcaccgcggccgggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggccctgaccctcgcgaccggccccatcacgaccctgtgggagggctccccggggaagttctggaacaccaccatcgccgtgagcatggccaacatcttccgcggctcctacctggccggggcgggcctcgccttcagcatcatgaagtccgtcgggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtgagccgcggctccgccaagctccagtggttcgtcgagcggaacatggtgatccccgaggggcgcgtgatcgacctgggctgcgggcgcggcgggtggagctactactgcgcgggcctgaagaaggtcaccgaggtgcggggctacaccaagggcgggcccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccgcaccatccgggtcctcaagatggtggagccctggctgcgcaacaaccagttctgcatcaaggtgctgaacccctacatgcccacggtcatcgagcacctcgagcggctgcagcgcaagtacggcgggatgctggtgcggaacccgctctcccgcaacagcacccacgagatgtactggatctccaacggcaccgggaacatcgtgagctccgtcaacatggtgagccggctgctgctcaaccgcttcaccatgacgcaccggcgccccaccatcgagaaggacgtcgacctgggcgccggcacccggcacgtgaacgccgagcccgagaccccgaacatggacgtgatcggggagcgcatcaagcggatcaaggaggagcactccagcacgtggcactacgacgacgagaacccctacaagacctgggcctaccacggctcctacgaggtcaaggccaccgggagcgcgagctccatgatcaacggcgtggtgaagctgctcaccaagccctgggacgtcgtgcccatggtgacgcagatggccatgaccgacaccaccccgttcgggcagcagcgcgtcttcaaggagaaggtggacacgcggacgccccggcccatgcccggcacccggaaggtgatggagatcaccgccgagtggctgtggcgcacgctgggccgcaacaagaagccgcggctctgcacccgcgaggagttcaccaagaaggtccggaccaacgccgccatgggggcggtgttcacggaggagaaccagtgggacagcgcccgcgccgccgtggaggacgaggagttctggaagctggtcgaccgggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgcggacgacaccgccggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccaccccgaaggggaccgtcatggacatcatctcccggaaggaccagcgcggcagcggccaggtggggacctacggcctcaacacgttcaccaacatggaggcccagctggtgcggcagatggagggggagggcgtcctgtccaaggcggacctcgagaacccccacctcctggagaagaagatcacccagtggctcgagaccaagggggtggagcgcctgaagcggatggccatcagcggcgacgactgcgtggtcaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtcgtgccctgccgcccccaggacgagctgatcgggcgggcgcgcatctcccagggcgccgggtggagcctgaaggagacggcctgcctcggcaaggcctacgcccagatgtggtccctgatgtacttccaccggcgcgacctgcggctcgcgagcaacgccatctgctccgccgtgccggtccactggatccccaccagccgcaccacctggagcatccacgcccaccaccagtggatgacgaccgaggacatgctgaccgtgtggaaccgggtgtggatcgaggacaacccctggatggaggacaagacccccgtcacgacctgggaggacgtgccgtacctgggcaagcgcgaggaccagtggtgcgggtccctcatcggcctgaccagccgggcgacctgggcccagaacatcctgacggccatccagcaggtccgctccctcatcggggacgaggagttcctggactacatgcccagcatgaagcggttccgcaaggaggaggagtccgagggcgccatctggtga

SEQ ID NO: 9932 - RNA, 9873 nt, synthetic construct
  misc_feature 1..9873: note = derived and/or modified CDS sequence (opt1) from DENV-3__GU131908__SS-prME
  source 1..9873: mol_type = other RNA
accagcctgtgcctcatgatgatgctgcccgcgaccctggccttccacctcaccagccgcgacggcgagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgccatcaactggaagggcaaggagctgaagtgcggctccgggatcttcgtgaccaacgaggtccacacgtggaccgagcagtacaagttccaggcggacagccccaagcgcctggccaccgccatcgccggcgcctggaagaacggggtgtgcggcatccgctccaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggccaagatcgtcaccgccgagacccagaactccagcttcatcatcgacggccccaacacccccgagtgcccctccgccagccgggcgtggaacgtgtgggaggtggaggactacgggttcggcgtcttcacgaccaacatctggctgaagctccgcgaggtgtacacccagagctgcgaccaccggctgatgtccgccgccatcaaggacgagcgcgccgtgcacgccgacatgggctactggatcgagagccagaagaacgggtcctggaagctggagaaggcgagcttcatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtgaagtccctggtcagcgccggctccgggaaggtggacaacttcaccatgggcgtgctgtgcctcgccatcctgttcgaggaggtcatgcgggggaagttcggcaagaagcacatgatcgcgggggtgctgttcacgttcgtgctcctgctgagcggccagatcacctggcgcgacatggcccacaccctcatcatgatcggctccaacgccagcgaccggatggggatgggcgtcacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgtccctgacgtgcagcaacaccatcttcaccctgaccgtcgcctggcgcacggccaccctcatcctggccggggtgtccctgctcccgctgtgccagagctccagcatgcggaagaccgactggctgcccatgaccgtcgcggccatgggcgtgccgcccctgccgctgttcatcttctccctgaaggacacgcccaagcgccgcagctggcccctcaacgagggggtgatggccgtcggcctggtgtccatcctggccagctccctcctgcggaacgacgtgcccatggccggcccgctggtcgccggcgggctcctgatcgcctgctacgtgatcaccgggaccagcgccgacctgaccgtggagaaggccgccgacgtcacgtgggaggaggaggcggagcagaccggggtgtcccacaacctcatgatcaccgtggacgacgacgggaccatgcgcatcaaggacgacgagaccgagaacatcctgacggtcctgctcaagaccgccctgctgatcgtgagcggcatcttcccctactccatccccgccaccctcctggtgtggcacacctggcagaagcagacgcagcggagcggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagcccaactgggcgagcgtcaagaaggacctcatctcctacggcgggggctggcggctgaacgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagacgaacgccgagcccgacggccccacccccgagctcgaggaggagatgttcaagaagcggaacctgaccatcatggacctgcacccggggagcggcaagacccgcaagtacctccccgccatcgtccgggaggccatcaagcgccggctgcgcacgctgatcctcgcgcccacccgggtggtggccgccgagatggaggaggccctgaaggggctgcccatccgctaccagaccaccgccacgaagtccgagcacaccggccgggagatcgtcgacctcatgtgccacgcgaccttcaccatgcgcctgctgagcccggtgcgggtgcccaactacaacctcgtcatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcgcagctggaactccggcaacgagtggatcaccgacttcgtggggaagaccgtctggttcgtgcccagcatcaaggccggcaacgacatcgccaactgcctgcggaagaacgggaagaaggtgatccagctgtcccgcaagaccttcgacacggagtaccagaagacccggctcaacgactgggacttcgtcgtgaccaccgacatcagcgagatgggcgcgaacttcaaggccgaccgcgtgatcgacccccggcgctgcctgaagcccgtcatcctgacggacggccccgagcgggtgatcctcgccgggccgatgcccgtgaccgccgcctccgcggcccagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtggagctcatgcggcgcggggacctgcccgtctggctggcccacaaggtggccagcgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtcacggagatcgggcgggtgccctcccacctggcgcaccgcacccggaacgccctggacaacctcgtgatgctgcacaccagcgagcacggcgggcgcgcctaccggcacgccgtcgaggagctgccggagaccatggagacgctcctgctgctcggcctgatgatcctgctcaccgggggcgccatgctgttcctgatcagcggcaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcgggatcctgacgctggccgcgatcgtggccgccaacgagatgggcctcctggagaccaccaagcgggacctgggcatgtccaaggagcccggggtcgtgagccccacctcctacctcgacgtggacctgcaccccgccagcgcctggacgctgtacgcggtcgccaccaccgtgatcaccccgatgctccgccacacgatcgagaactccaccgccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacgcactacgccatcatcggcccgggcctgcaggccaaggccacccgggaggcccagaagcgcaccgcggccgggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggccctgaccctcgcgaccggccccatcacgaccctgtgggagggctccccggggaagttctggaacaccaccatcgccgtgagcatggccaacatcttccgcggctcctacctggccggggcgggcctcgccttcagcatcatgaagtccgtcgggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtgagccgcggctccgccaagctccagtggttcgtcgagcggaacatggtgatccccgaggggcgcgtgatcgacctgggctgcgggcgcggcgggtggagctactactgcgcgggcctgaagaaggtcaccgaggtgcggggctacaccaagggcgggcccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccgcaccatccgggtcctcaagatggtggagccctggctgcgcaacaaccagttctgcatcaaggtgctgaacccctacatgcccacggtcatcgagcacctcgagcggctgcagcgcaagtacggcgggatgctggtgcggaacccgctctcccgcaacagcacccacgagatgtactggatctccaacggcaccgggaacatcgtgagctccgtcaacatggtgagccggctgctgctcaaccgcttcaccatgacgcaccggcgccccaccatcgagaaggacgtcgacctgggcgccggcacccggcacgtgaacgccgagcccgagaccccgaacatggacgtgatcggggagcgcatcaagcggatcaaggaggagcactccagcacgtggcactacgacgacgagaacccctacaagacctgggcctaccacggctcctacgaggtcaaggccaccgggagcgcgagctccatgatcaacggcgtggtgaagctgctcaccaagccctgggacgtcgtgcccatggtgacgcagatggccatgaccgacaccaccccgttcgggcagcagcgcgtcttcaaggagaaggtggacacgcggacgccccggcccatgcccggcacccggaaggtgatggagatcaccgccgagtggctgtggcgcacgctgggccgcaacaagaagccgcggctctgcacccgcgaggagttcaccaagaaggtccggaccaacgccgccatgggggcggtgttcacggaggagaaccagtgggacagcgcccgcgccgccgtggaggacgaggagttctggaagctggtcgaccgggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgcggacgacaccgccggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccaccccgaaggggaccgtcatggacatcatctcccggaaggaccagcgcggcagcggccaggtggggacctacggcctcaacacgttcaccaacatggaggcccagctggtgcggcagatggagggggagggcgtcctgtccaaggcggacctcgagaacccccacctcctggagaagaagatcacccagtggctcgagaccaagggggtggagcgcctgaagcggatggccatcagcggcgacgactgcgtggtcaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtcgtgccctgccgcccccaggacgagctgatcgggcgggcgcgcatctcccagggcgccgggtggagcctgaaggagacggcctgcctcggcaaggcctacgcccagatgtggtccctgatgtacttccaccggcgcgacctgcggctcgcgagcaacgccatctgctccgccgtgccggtccactggatccccaccagccgcaccacctggagcatccacgcccaccaccagtggatgacgaccgaggacatgctgaccgtgtggaaccgggtgtggatcgaggacaacccctggatggaggacaagacccccgtcacgacctgggaggacgtgccgtacctgggcaagcgcgaggaccagtggtgcgggtccctcatcggcctgaccagccgggcgacctgggcccagaacatcctgacggccatccagcaggtccgctccctcatcggggacgaggagttcctggactacatgcccagcatgaagcggttccgcaaggaggaggagtccgagggcgccatctggtga

SEQ ID NO: 9933 - RNA, 9873 nt, synthetic construct
  misc_feature 1..9873: note = derived and/or modified CDS sequence (opt1) from DENV-3__GU131909__SS-prME
  source 1..9873: mol_type = other RNA
accagcctctgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacctgggccttccgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagagcaagcccaccctcgacatcgagctgcagaagaccgaggccacccagctggcgacgctccggaagctgtgcatcgagggcaagatcaccaacatcaccaccgactcccgctgccccacgcagggcgaggccaccctgccggaggagcaggaccagaactacgtgtgcaagcacacctacgtcgaccgggggtggggcaacgggtgcggcctcttcgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgacacccagggggtgacggtcgagatcacgccccaggcctccaccgtggaggccgtgctgcccgagtacggcaccctggggctcgagtgcagcccgcgcaccggcctggacttcaacgagatgatcctgctcacgatgaagaacaaggcgtggatggtccaccggcagtggttcttcgacctgcccctgccctggacctccggcgccaccaccgagacgcccacctggaaccgcaaggagctcctggtgaccttcaagaacgcccacgccaagaagcaggaggtggtcgtgctggggagccaggagggcgccatgcacaccgcgctcacgggggccaccgagatccagaactccggcgggaccagcatcttcgccggccacctgaagtgccggctgaagatggacaagctcgagctgaagggcatgtcctacgccatgtgcctgaacaccttcgtgctcaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctgaagatcaactggtacaagaagggcagctccatcgggaagatgttcgaggcgaccgcccggggcgcccgccggatggccatcctcggcgacaccgcctgggacttcgggagcgtcggcggggtgctgaactccctgggcaagatggtgcaccagatcttcgggagcgcgtacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggccgacatggggtgcgccatcaactggaagggcaaggagctcaagtgcggctccgggatcttcgtgaccaacgaggtccacacgtggaccgagcagtacaagttccaggcggacagccccaagcgcctggccaccgccatcgccggcgcctgggagaacggggtgtgcggcatccgctccaccacgcggatggagaacctgctctggaagcagatcgcgaacgagctgaactacatcctgtgggagaacaacatcaagctcaccgtggtcgtgggggacatcatcggcgtgctggagcagggcaagcgcaccctgacgccccagccgatggagctcaagtacagctggaagacgtgggggaaggccaagatcgtcaccgccgagacccagaactccagcttcatcatcgacggccccaacacccccgagtgcccctccgccagccgggcgtggaacgtgtgggaggtggaggactacgggttcggcgtcttcacgaccaacatctggctgaagctgcgcgaggtgtacacccagagctgcgaccaccggctcatgtccgccgccatcaaggacgagcgcgccgtgcacgccgacatgggctactggatcgagagccagaagaacgggtcctggaagctggagaaggcgagcttcatcgaggtcaagacctgcacctggccgaagtcccacacgctgtggagcaacggcgtgctcgagtccgacatgatcatccccaagagcctggccgggcccatctcccagcacaaccaccggccgggctaccacacccagaccgccgggccctggcacctgggcaagctcgagctggacttcaactactgcgagggcaccacggtggtcatcaccgagaactgcgggacccgcggccccagcctgcggaccacgaccgtgtccgggaagctcatccacgagtggtgctgccgcagctgcaccctgcccccgctgcggtacatgggcgaggacgggtgctggtacggcatggagatccgccccatcaacgagaaggaggagaacatggtgaagtccctcgtcagcgccggctccgggaaggtggacaacttcaccatgggcgtgctgtgcctggccatcctcttcgaggaggtcatgcgggggaagttcggcaagaagcacatgatcgcgggggtgctgttcacgttcgtgctgctcctgagcggccagatcacctggcgcgacatggcccacaccctgatcatgatcggctccaacgccagcgaccggatggggatgggcgtcacctacctcgccctgatcgccacgttcaagatccagcccttcctggcgctcgggttcttcctgcgcaagctgaccagccgggagaacctcctgctgggcgtgggcctcgccatggccaccaccctgcagctgcccgaggacatcgagcagatggccaacgggatcgcgctcggcctgatgacgctgaagctcatcacccagttcgagacctaccagctgtggaccgccctggtgtccctcacgtgcagcaacaccatcttcaccctgaccgtcgcctggcgcacggccaccctgatcctcgccggggtgtccctgctgccgctctgccagagctccagcatgcggaagaccgactggctgcccatgaccgtcgcggccatgggcgtgccgcccctccccctcttcatcttctccctgaaggacacgcccaagcgccgcagctggcccctgaacgagggggtgatggccgtcggcctcgtgtccatcctggccagctccctgctccggaacgacgtgcccatggccggcccgctggtcgccggcgggctgctcatcgcctgctacgtgatcaccgggaccagcgccgacctgaccgtggagaaggccgccgacgtcacgtgggaggaggaggcggagcagaccggggtgtcccacaacctgatgatcaccgtggacgacgacgggaccatgcgcatcaaggacgacgagaccgagaacatcctcacggtcctgctgaagaccgccctcctgatcgtgagcggcatcttcccctactccatccccgccaccctgctcgtgtggcacacctggcagaagcagacgcagcggagcggcgtcctgtgggacgtgccctccccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgccgtgctcacccacaacgggaagcgcctggagcccaactgggcgagcgtcaagaaggacctgatctcctacggcgggggctggcggctcaacgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagacgaacgccgagcccgacggccccacccccgagctggaggaggagatgttcaagaagcggaacctcaccatcatggacctgcacccggggagcggcaagacccgcaagtacctgcccgccatcgtccgggaggccatcaagcgccggctccgcacgctgatcctggcgcccacccgggtggtggccgccgagatggaggaggccctcaaggggctgcccatccgctaccagaccaccgccacgaagtccgagcacaccggccgggagatcgtcgacctgatgtgccacgcgaccttcaccatgcgcctcctgagcccggtgcgggtgcccaactacaacctggtcatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcgcagctggaactccggcaacgagtggatcaccgacttcgtggggaagaccgtctggttcgtgcccagcatcaaggccggcaacgacatcgccaactgcctccggaagaacgggaagaaggtgatccagctgtcccgcaagaccttcgacacggagtaccagaagacccggctgaacgactgggacttcgtcgtgaccaccgacatcagcgagatgggcgcgaacttcaaggccgaccgcgtgatcgacccccggcgctgcctcaagcccgtcatcctgacggacggccccgagcgggtgatcctggccgggccgatgcccgtgaccgccgcctccgcggcccagcgccggggccgcgtcgggcggaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgcgagaagtccgcggccatcgacggcgagtaccggctgaagggcgagtcccgcaagacgttcgtggagctgatgcggcgcggggacctccccgtctggctggcccacaaggtggccagcgagggcatcaagtacaccgaccggaagtggtgcttcgacggggagcgcaacaaccagatcctggaggagaacatggacgtggagatctggaccaaggagggcgagcggaagaagctccgcccgcgctggctggacgcgcggacctactccgaccccctggccctcaaggagttcaaggacttcgccgccggccgcaagagcatcgccctggacctggtcacggagatcgggcgggtgccctcccacctcgcgcaccgcacccggaacgccctggacaacctggtgatgctccacaccagcgagcacggcgggcgcgcctaccggcacgccgtcgaggagctgccggagaccatggagacgctgctcctgctgggcctcatgatcctgctgaccgggggcgccatgctgttcctgatcagcggcaaggggatcggcaagacctccatcgggctgatctgcgtgatcgtgagctccggcatgctctggatggcggacgtccccctgcagtggatcgccagcgccatcgtgctggagttcttcatgatggtgctcctgatccccgagcccgagaagcagcgcaccccgcaggacaaccagctggcctacgtcgtgatcgggatcctcacgctggccgcgatcgtggccgccaacgagatgggcctgctcgagaccaccaagcgggacctgggcatgtccaaggagcccggggtcgtgagccccacctcctacctggacgtggacctccaccccgccagcgcctggacgctgtacgcggtcgccaccaccgtgatcaccccgatgctgcgccacacgatcgagaactccaccgccaacgtgagcctcgccgcgatcgccaaccaggccgtcgtgctgatgggcctggacaaggggtggcccatctccaagatggacctcggcgtgcccctgctggccctcgggtgctacagccaggtcaaccccctgaccctgaccgccgcggtgctcctgctggtgacgcactacgccatcatcggcccgggcctccaggccaaggccacccgggaggcccagaagcgcaccgcggccgggatcatgaagaaccccaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggccctgaccctggcgaccggccccatcacgaccctctgggagggctccccggggaagttctggaacaccaccatcgccgtgagcatggccaacatcttccgcggctcctacctggccggggcgggcctggccttcagcatcatgaagtccgtcgggacgggccggcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagacgacccaccacgccgtgagccgcggctccgccaagctgcagtggttcgtcgagcggaacatggtgatccccgaggggcgcgtgatcgacctcggctgcgggcgcggcgggtggagctactactgcgcgggcctgaagaaggtcaccgaggtgcggggctacaccaagggcgggcccgggcacgaggagcccgtgccgatgtccacgtacggctggaacatcgtcaagctgatgagcgggaaggacgtgttctacctgccgcccgagaagtgcgacaccctgctgtgcgacatcggcgagtccagcccctccccgaccgtggaggagagccgcaccatccgggtcctgaagatggtggagccctggctccgcaacaaccagttctgcatcaaggtgctgaacccctacatgcccacggtcatcgagcacctggagcggctccagcgcaagtacggcgggatgctggtgcggaacccgctgtcccgcaacagcacccacgagatgtactggatctccaacggcaccgggaacatcgtgagctccgtcaacatggtgagccggctcctgctgaaccgcttcaccatgacgcaccggcgccccaccatcgagaaggacgtcgacctcggcgccggcacccggcacgtgaacgccgagcccgagaccccgaacatggacgtgatcggggagcgcatcaagcggatcaaggaggagcactccagcacgtggcactacgacgacgagaacccctacaagacctgggcctaccacggctcctacgaggtcaaggccaccgggagcgcgagctccatgatcaacggcgtggtgaagctgctgaccaagccctgggacgtcgtgcccatggtgacgcagatggccatgaccgacaccaccccgttcgggcagcagcgcgtcttcaaggagaaggtggacacgcggacgccccggcccatgcccggcacccggaaggtgatggagatcaccgccgagtggctctggcgcacgctgggccgcaacaagaagccgcggctgtgcacccgcgaggagttcaccaagaaggtccggaccaacgccgccatgggggcggtgttcacggaggagaaccagtgggacagcgcccgcgccgccgtggaggacgaggagttctggaagctcgtcgaccgggagcgcgagctgcacaagctgggcaagtgcgggtcctgcgtgtacaacatgatgggcaagcgggagaagaagctcggggagttcggcaaggcgaagggcagccgcgccatctggtacatgtggctgggggcccggtacctggagttcgaggccctcggcttcctgaacgaggaccactggttctcccgcgagaacagctactccggggtggagggcgaggggctgcacaagctcggctacatcctgcgggacatcagcaagatccccggcggggccatgtacgcggacgacaccgccggctgggacacccgcatcaccgaggacgacctgcacaacgaggagaagatcacgcagcagatggaccccgagcaccggcagctcgccaacgccatcttcaagctgacctaccagaacaaggtcgtgaaggtgcagcgccccaccccgaaggggaccgtcatggacatcatctcccggaaggaccagcgcggcagcggccaggtggggacctacggcctgaacacgttcaccaacatggaggcccagctcgtgcggcagatggagggggagggcgtcctgtccaaggcggacctggagaacccccacctcctggagaagaagatcacccagtggctggagaccaagggggtggagcgcctcaagcggatggccatcagcggcgacgactgcgtggtcaagcccatcgacgaccgcttcgccaacgccctgctggccctcaacgacatgggcaaggtgcggaaggacatcccccagtggcagccgtccaaggggtggcacgactggcagcaggtccccttctgcagccaccacttccacgagctgatcatgaaggacggccgcaagctggtcgtgccctgccgcccccaggacgagctcatcgggcgggcgcgcatctcccagggcgccgggtggagcctgaaggagacggcctgcctgggcaaggcctacgcccagatgtggtccctcatgtacttccaccggcgcgacctgcggctggcgagcaacgccatctgctccgccgtgccggtccactggatccccaccagccgcaccacctggagcatccacgcccaccaccagtggatgacgaccgaggacatgctcaccgtgtggaaccgggtgtggatcgaggacaacccctggatggaggacaagacccccgtcacgacctgggaggacgtgccgtacctgggcaagcgcgaggaccagtggtgcgggtccctgatcggcctcaccagccgggcgacctgggcccagaacatcctgacggccatccagcaggtccgctccctgatcggggacgaggagttcctcgactacatgcccagcatgaagcggttccgcaaggaggaggagtccgagggcgccatctggtga

SEQ ID NO: 9934 - RNA, 9873 nt, synthetic construct
  misc_feature 1..9873: note = derived and/or modified CDS sequence (opt1) from DENV-3__GU131912__SS-prME
  source 1..9873: mol_type = other RNA
accagcctgtgcctcatgatgatgctgcccgccaccctggccttccacctcaccagccgggacggggagccgcggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcatcctgctcatgctggtgacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccaacatcttcgccggccacctgaagtgccggctcaagatggacaagctggagctgaagggcatgagctacgccatgtgcctcaacaccttcgtgctgaagaaggaggtctccgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccatcaacatcgaggccgagccgcccttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacgtggatcggcctgaacagcaagaacacctccatgagcttctcctgcatcgtgatcgggatcatcaccctgtacctcggcgccgtggtccaggccgacatggggtgcgtgatcaactggaagggcaaggagctgaagtgcggcaacgggatcttcgtgaccaacgaggtccacacgtggaccgagcagtacaagttccaggccgacagccccaagcgcctggcgaccgccatcgccggctcctgggagaacggggtgtgcggcatccgcagcaccacgcggatggagaacctcctgtggaagcagatcgccaacgagctgaactacatcctctgggagaacaacatcaagctgaccgtggtcgtgggggacatcatcggcgtgctggagcagggcaagcgcaccctcacgccccagccgatggagctgaagtactcctggaagacgtgggggaaggccaagatcgtcaccgcggagacccagaacagctccttcatcatcgacggccccaacacccccgagtgccccagcgcctcccgggcctggaacgtgtgggaggtggaggactacgggttcggcgtcttcacgaccaacatctggctgaagctccgcgaggtgtacacccagagctgcgaccaccggctgatgagcgccgcgatcaaggacgagcgcgccgtgcacgccgacatgggctactggatcgagtcccagaagaacgggagctggaagctggagaaggcctccttcatcgaggtcaagacctgcacctggcccaagagccacacgctctggtccaacggcgtgctggagagcgacatgatcatccccaagtccctggccgggcccatcagccagcacaaccaccggccgggctaccacacccagaccgcggggccctggcacctcggcaagctggagctggacttcaactactgcgagggcaccacggtggtcatcgccgagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgccggggtgctgttcaccttcgtgctcctgctgtccggccagatcacgtggcgcgacatggcgcacaccctcatcatgatcggcagcaacgcctccgaccggatggggatgggcgtcacctacctggccctgatcgccaccttcaagatccagcccttcctcgccctggggttcttcctgcgcaagctcacgagccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgccgcgatgggcgtgccgcccctgccgctgttcatcttcagcctgaaggacacccccaagcgcaagtcctggcccctcaacgagggggtgatggccgtcggcctggtgagcatcctggcctccagcctcctgcgcaacgacgtgcccatggccggcccgctggtcgccgggggcctcctgatcgcgtgctacgtgatcacggggacctccgccgacctgaccgtggagaaggccgccgacgtcacctgggaggaggaggccgagcagacgggcgtgagccacaacctcatgatcaccgtggacgacgacgggaccatgcggatcaaggacgacgagaccgagaacatcctgaccgtcctgctcaagacggcgctgctgatcgtgtccggcatcttcccctacagcatccccgccaccctcctggtgtggcacacctggcagaagcagacccagcgctccggcgtcctgtgggacgtgcccagcccgcccgagacgcagaaggccgagctcgaggagggggtgtaccggatcaagcagcagggcatcttcgggaagacccaggtcggcgtgggggtgcagaaggagggcgtcttccacaccatgtggcacgtgacccgcggcgccgtgctgacgcacaacgggaagcggctggagcccaactgggcctccgtcaagaaggacctcatcagctacggcgggggctggcgcctgtccgcgcagtggcagaagggggaggaggtccaggtgatcgccgtcgagcccggcaagaacccgaagaacttccagaccatgcccggcatcttccagaccaccacgggggagatcggcgccatcgccctggacttcaagcccgggaccagcggcagcccgatcatcaaccgggagggcaaggtggtggggctgtacggcaacggggtcgtgaccaagaacggcgggtacgtgtccggcatcgcgcagaccaacgccgagcccgacggccccacgcccgagctcgaggaggagatgttcaagaagcgcaacctgaccatcatggacctgcacccggggagcggcaagacccggaagtacctccccgccatcgtccgcgaggccatcaagcggcgcctgcggaccctgatcctcgcccccacgcgcgtggtggcggccgagatggaggaggccctgaaggggctgcccatccggtaccagaccaccgcctccaagagcgagcacaccggccgcgagatcgtcgacctcatgtgccacgccacgttcaccatgcggctgctgtccccggtgcgcgtgcccaactacaacctcatcatcatggacgaggcgcacttcaccgaccccgccagcatcgccgcccgggggtacatctccacccgcgtcggcatgggcgaggccgcggccatcttcatgacggccacgccgcccgggaccgccgaggcgttcccccagagcaacgcccccatccaggacgaggagcgggacatccccgagcgctcctggaacagcggcaacgagtggatcaccgacttcgtggggaagacggtgtggttcgtcccctccatcaaggccggcaacgacatcgccaactgcctgcgcaagaacgggaagaaggtgatccagctgagccggaagaccttcgacaccgagtaccagaagacccgcctcaacgactgggacttcgtggtcacgaccgacatctccgagatgggcgccaacttcaaggcggaccgggtgatcgacccccgccggtgcctgaagcccgtgatcctgaccgacggccccgagcgcgtcatcctcgccgggccgatgcccgtgaccgccgccagcgccgcgcagcggcgcggccgggtggggcgcaacccccagaaggagaacgaccagtacatcttcacgggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagagccggaagaccttcgtcgagctcatgcgccgcggggacctgcccgtgtggctggcccacaaggtcgcctccgagggcatcaagtacaccgaccgcaagtggtgcttcgacggggagcggaacaaccagatcctcgaggagaacatggacgtggagatctggacgaaggagggcgagcgcaagaagctgcggccgcgctggctggacgcccgcacctacagcgaccccctcgcgctgaaggagttcaaggacttcgccgccggccggaagtccatcgccctggacctcgtgaccgagatcgggcgcgtccccagccacctggcccaccggacccgcaacgcgctggacaacctcgtgatgctgcacacgagcgagcacggcgggcgggcctaccgccacgccgtggaggagctgccggagaccatggagaccctcctgctgctcggcctgatgatcctgctcaccgggggcgccatgctgttcctgatctccggcaaggggatcggcaagacgagcatcgggctcatctgcgtcatcgtgtccagcggcatgctgtggatggccgacgtgcccctgcagtggatcgcgtccgccatcgtcctcgagttcttcatgatggtgctgctgatccccgagcccgagaagcagcggaccccgcaggacaaccagctcgcctacgtggtcatcgggatcctgaccctggccgccatcgtggcggccaacgagatgggcctcctggagaccacgaagcgcgacctgggcatgagcaaggagcccggggtggtctcccccaccagctacctcgacgtggacctgcaccccgcctccgcctggaccctgtacgccgtggcgaccacggtcatcaccccgatgctccggcacaccatcgagaacagcaccgccaacgtgtccctggccgccatcgcgaaccaggccgtggtcctgatgggcctcgacaaggggtggcccatcagcaagatggacctgggcgtgcccctgctcgccctggggtgctactcccaggtgaaccccctgacgctcaccgccgccgtcctgctgctcgtgacccactacgcgatcatcggcccgggcctgcaggccaaggccacccgcgaggcccagaagcggacggccgcggggatcatgaagaaccccaccgtggacggcatcatgaccatcgacctggaccccgtcatctacgacagcaagttcgagaagcagctcggccaggtgatgctgctggtgctctgcgccgtccagctgctgctcatgcgcacctcctgggccctgtgcgaggccctgacgctcgccaccggccccatcaccaccctgtgggagggcagcccggggaagttctggaacacgaccatcgcggtgtccatggccaacatcttccggggcagctacctggccggggccggcctcgcgttctccatcatgaagtccgtggggaccggccgccggggcaccgggagccagggcgagacgctgggggagaagtggaagaagaagctgaaccagctctcccgcaaggagttcgacctgtacaagaagtccggcatcaccgaggtcgaccggaccgaggccaaggaggggctgaagcgcggcgagaccacccaccacgccgtgtcccggggcagcgccaagctccagtggttcgtggagcgcaacatggtcatccccgaggggcgggtgatcgacctgggctgcgggcgcggcgggtggtcctactactgcgccggcctgaagaaggtgacggaggtccgcggctacaccaagggcgggcccgggcacgaggagcccgtgccgatgagcacctacggctggaacatcgtgaagctcatgtccgggaaggacgtcttctacctgccgcccgagaagtgcgacaccctgctgtgcgacatcggcgagagctcccccagcccgacggtggaggagtcccggaccatccgcgtgctccggatggtcgagccctggctgcgcaacaaccagttctgcatcaaggtgctgaacccctacatgcccaacgtgatcgagcacctcgagcggctgcagcgcaagtacggcgggatgctggtccggaacccgctcagccgcaactccacccacgagatgtactggatcagcaacggcaccgggaacatcgtgtccagcgtgaacatggtctcccggctgctgctcaaccgcttcacgatgacccaccggcgccccaccatcgagaaggacgtggacctgggcgcgggcacccggcacgtcaacgccgagcccgagacgccgaacatggacgtgatcggggagcgcatcaagcggatcaaggaggagcacagctccacctggcactacgacgacgagaacccctacaagacctgggcctaccacggcagctacgaggtgaaggccaccgggagcgcctccagcatgatcaacggcgtcgtgaagctgctcacgaagccctgggacgtggtccccatggtgacccagatggcgatgaccgacaccacgccgttcgggcagcagcgcgtgttcaaggagaaggtcgacacccggacgccccggcccatgcccggcacccggaaggtgatggagatcacggccgagtggctgtggcgcaccctgggccgcaacaagaagccgcggctctgcacccgcgaggagttcaccaagaaggtgcggacgaacgccgccatgggggccgtcttcaccgaggagaaccagtgggactccgcgcgcgccgccgtggaggacgaggagttctggaagctggtggacaaggagcgggagctgcacaagctcggcaagtgcgggagctgcgtctacaacatgatgggcaagcgcgagaagaagctgggggagttcggcaaggccaagggctcccgggcgatctggtacatgtggctgggggcccgctacctcgagttcgaggccctgggcttcctgaacgaggaccactggttcagccgggagaactcctacagcggggtggagggcgaggggctccacaagctgggctacatcctgcgcgacatctccaagatccccggcggggccatgtacgccgacgacaccgcgggctgggacacccggatcacggaggacgacctccacaacgaggagaagatcacccagcagatggaccccgagcaccgccagctggccaacgccatcttcaagctgacctaccagaacaaggtggtcaaggtgcagcggcccaccccgaaggggacggtgatggacatcatcagccgcaaggaccagcggggctccggccaggtcgggacctacggcctcaacaccttcaccaacatggaggcccagctggtgcgccagatggagggggagggcgtgctgagcgaggccgacctcgagaacccccacctcctggagaagaagatcacccagtggctcgagacgaagggggtcgagcggctgaagcgcatggcgatctccggcgacgactgcgtggtgaagcccatcgacgaccggttcgccaacgccctgctcgccctgaacgacatgggcaaggtccgcaaggacatcccccagtggcagccgagcaaggggtggcacgactggcagcaggtccccttctgctcccaccacttccacgagctgatcatgaaggacggccggaagctcgtggtcccctgccgcccccaggacgagctgatcgggcgcgcccggatcagccagggcgcggggtggtccctgaaggagaccgcctgcctcggcaaggcctacgcccagatgtggagcctgatgtacttccaccgccgggacctgcgcctcgcctccaacgcgatctgcagcgccgtgccggtgcactggatccccaccagccggaccacgtggtccatccacgcccaccaccagtggatgaccaccgaggacatgctgaccgtctggaaccgcgtgtggatcgaggacaacccctggatggaggacaagacgcccgtgaccacctgggaggacgtcccgtacctgggcaagcgggaggaccagtggtgcgggagcctcatcggcctgacctcccgcgccacgtgggcgcagaacatcctgaccgccatccagcaggtccggagcctcatcggggacgaggagttcctggactacatgccctccatgaagcgcttccggaaggaggaggagagcgagggcgccatctggtga

SEQ ID NO: 9935 - RNA, 9873 nt, synthetic construct
  misc_feature 1..9873: note = derived and/or modified CDS sequence (opt1) from DENV-3__GU131913__SS-prME
  source 1..9873: mol_type = other RNA
accagcctgtgcctcatgatgatgctgcccgcgaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacctgcaaccaggccggcgagcaccggcgggacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccatcaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtgggcggggtcctgaactccctcggcaagatggtgcaccagatcttcgggagcgcgtacaccgccctgttctccggcgtgagctggatcatgaagatcggcatcggggtcctgctcacgtggatcggcctgaactccaagaacaccagcatgtccttcagctgcatcgtgatcgggatcgtgaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgcctcccgggcctggaacgtgtgggaggtcgaggactacgggttcggcgtgttcacgaccaacatctggctgaagctccgcgaggtgcacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtcgtgatcgccgagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcaccttcgtcctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgcaagtcctggcccctcaacgagggggtcatggccgtgggcctggtgagcatcctggcctccagcctcctgcgcaacgacgtccccatggccggcccgctggtggccggcgggctcctgatcgcctgctacgtgatcacggggacctccgccgacctgaccgtcgagaaggccgccgacgtgacctgggaggaggaggcggagcagacgggggtgagccacaacctcatgatcaccgtcgacgacgacgggaccatgcggatcaaggacgacgagaccgagaacatcctgaccgtgctgctcaagacggccctgctgatcgtgtccggcatcttcccctacagcatccccgccaccctcctggtctggcacacctggcagaagcagacccagcgctccggcgtgctgtgggacgtgcccagcccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggcgtccgtgaagaaggacctcatcagctacggcgggggctggcgcctgtccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtcgggctgtacggcaacggggtggtgaccaagaacggcgggtacgtctccggcatcgcccagaccaacgccgagcccgacggccccacgcccgagctcgaggaggagatgttcaagaagcgcaacctgaccatcatggacctgcacccggggagcggcaagacccggaagtacctccccgccatcgtgcgcgaggccatcaagcggcgcctgcggaccctgatcctcgcgcccacgcgcgtggtcgccgccgagatggaggaggccctgaaggggctgcccatccggtaccagaccaccgccaccaagtccgagcacacgggccgcgagatcgtggacctcatgtgccacgcgaccttcaccatgcggctgctgagcccggtgcgcgtccccaactacaacctcgtgatcatggacgaggcccacttcaccgaccccgcctccatcgccgcccgggggtacatcagcacgcgcgtgggcatgggcgaggcggccgccatcttcatgaccgccacgccgcccgggaccgcggaggccttcccccagtccaacgcccccatccaggacgaggagcgggacatccccgagcgcagctggaactccggcaacgagtggatcacggacttcgtcgggaagaccgtgtggttcgtgcccagcatcaaggccggcaacgacatcgccaactgcctgcgcaagaacgggaagaaggtcatccagctgtcccggaagaccttcgacaccgagtaccagaagacgcgcctcaacgactgggacttcgtggtgaccaccgacatcagcgagatgggcgcgaacttcaaggccgaccgggtcatcgacccccgccggtgcctgaagcccgtgatcctgaccgacggccccgagcgcgtgatcctcgccgggccgatgcccgtcacggccgcctccgcggcccagcggcgcggccgggtggggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagaccttcgtcgagctcatgcgccgcggggacctgcccgtgtggctggcccacaaggtggccagcgagggcatcaagtacacggaccgcaagtggtgcttcgacggggagcggaacaaccagatcctcgaggagaacatggacgtcgagatctggaccaaggagggcgagcgcaagaagctgcggccgcgctggctggacgcgcgcacctactccgaccccctcgccctgaaggagttcaaggacttcgccgccggccgcaagagcatcgccctggacctcgtgaccgagatcgggcgcgtgccctcccacctggcgcaccggacgcgcaacgccctggacaacctcgtcatgctgcacaccagcgagcacggcgggcgggcctaccgccacgccgtggaggagctgccggagaccatggagaccctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcggaccccgcaggacaaccagctcgcctacgtggtgatcgggatcctgaccctggccgcgatcgtcgccgccaacgagatgggcctcctggagacgaccaagcgcgacctgggcatgtccaaggagcccggggtggtgagccccacctcctacctcgacgtcgacctgcaccccgccagcgcctggaccctgtacgcggtggccacgaccgtgatcaccccgatgctccggcacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgcgaggcccagaagcggaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcgcacgagctgggccctgtgcgaggccctgaccctcgcgaccggccccatcaccacgctgtgggagggctccccggggaagttctggaacaccaccatcgccgtcagcatggccaacatcttccggggctcctacctggccggggcgggcctcgccttcagcatcatgaagtccgtggggaccggccgccggggcacggggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagaccacgcaccacgccgtcagccggggctccgccaagctccagtggttcgtggagcgcaacatggtgatccccgaggggcgggtcatcgacctgggctgcgggcgcggcgggtggagctactactgcgcgggcctgaagaaggtgaccgaggtgcgcggctacaccaagggcggccccgggcacgaggagcccgtcccgatgtccacctacggctggaacatcgtgaagctcatgagcgggaaggacgtgttctacctgccgcccgagaagtgcgacacgctgctgtgcgacatcggcgagtccagcccctccccgaccgtcgaggagagccggaccatccgcgtgctcaagatggtggagccctggctgcggaacaaccagttctgcatcaaggtcctgaacccctacatgcccaacgtgatcgagcacctcgagcgcctgcagcggaagtacggcgggatgctggtgcgcaacccgctctcccggaacagcacccacgagatgtactggatctccaacggcacggggaacatcgtcagctccgtgaacatggtcagccgcctgctgctcaaccggttcaccatgacccaccgccggcccaccatcgagaaggacgtggacctgggcgccggcacgcgccacgtgaacgccgagcccgagaccccgaacatggacgtcatcggggagcggatcaagcgcatcaaggaggagcactccagcacctggcactacgacgacgagaacccctacaagacctgggcctaccacggctcctacgaggtgaaggccacggggagcgcgagctccatgatcaacggcgtggtcaagctgctcaccaagccctgggacgtggtgcccatggtcacccagatggccatgaccgacacgaccccgttcgggcagcagcgggtgttcaaggagaaggtggacacccgcacgccccggcccatgcccggcacgcgcaaggtcatggagatcaccgccgagtggctgtggcggaccctgggccgcaacaagaagccgcgcctctgcacccgggaggagttcacgaagaaggtgcgcaccaacgccgccatgggggcggtgttcaccgaggagaaccagtgggacagcgcccgggccgccgtcgaggacgaggagttctggaagctggtggacaaggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagctactccggggtcgagggcgaggggctccacaagctgggctacatcctgcgggacatcagcaagatccccggcggggccatgtacgcggacgacaccgccggctgggacacgcgcatcaccgaggacgacctccacaacgaggagaagatcacccagcagatggaccccgagcaccggcagctggccaacgccatcttcaagctgacctaccagaacaaggtggtgaaggtccagcgccccacgccgaaggggaccgtgatggacatcatctcccggaaggaccagcgcggcagcggccaggtggggacctacggcctcaacaccttcaccaacatggaggcccagctggtccggcagatggagggggagggcgtgctgtccgaggcggacctcgagaacccccacctcctggagaagaagatcacgcagtggctcgagaccaagggggtggagcgcctgaagcggatggccatcagcggcgacgactgcgtcgtgaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtggtgccctgccggccccaggacgagctgatcgggcgcgcgcgcatctcccagggcgccgggtggagcctgaaggagaccgcctgcctcggcaaggcctacgcccagatgtggtccctgatgtacttccaccggcgcgacctgcggctcgcgagcaacgccatctgctccgccgtcccggtgcactggatccccaccagccgcacgacctggagcatccacgcccaccaccagtggatgaccaccgaggacatgctgacggtgtggaaccgggtctggatcgaggacaacccctggatgggcgacaagacccccgtgaccacctgggaggacgtgccgtacctggggaagcgcgaggaccagtggtgcggctccctcatcgggctgacgagccgggcgacctgggcccagaacatcctgaccgccatccagcaggtccgctccctcatcggcgacgaggagttcctggactacatgcccagcatgaagcggttccgcaaggaggaggagtccgagggggccatctggtga

SEQ ID NO: 9936 - RNA, 9873 nt, synthetic construct
  misc_feature 1..9873: note = derived and/or modified CDS sequence (opt1) from DENV-3__GU131914__SS-prME
  source 1..9873: mol_type = other RNA
accagcctgtgcctcatgatgatgctgcccgcgaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgggacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtgacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccatcaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtgggcggggtcctgaactccctcggcaagatggtgcaccagatcttcgggagcgcgtacaccgccctgttctccggcgtgagctggatcatgaagatcggcatcggggtcctgctcacgtggatcggcctgaactccaagaacaccagcatgtccttcagctgcatcgtgatcgggatcatcaccctgtacctcggcgccgtggtccaggccgacatggggtgcgtgatcaactggaagggcaaggagctgaagtgcggcaacgggatcttcgtgaccaacgaggtccacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtggtcgtgggggacatcatcggcgtgctggagcagggcaagcgcaccctcacgccccagccgatggagctgaagtactcctggaagacgtgggggaaggcgaagatcgtcaccgccgagacccagaacagctccttcatcatcgacggccccaacacccccgagtgccccagcgcctcccgggcctggaacgtgtgggaggtggaggactacgggttcggcgtcttcacgaccaacatctggctgaagctccgcgaggtgcacacccagagctgcgaccaccggctgatgagcgcggccatcaaggacgagcgcgccgtgcacgccgacatgggctactggatcgagtcccagaagaacgggagctggaagctggagaaggcctccttcatcgaggtcaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtggtcatcgccgagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgcaagtcctggcccctcaacgagggggtgatggccgtcggcctggtgagcatcctggcctccagcctcctgcgcaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcggatcaaggacgacgagaccgagaacatcctgaccgtcctgctcaagacggccctgctgatcgtgtccggcatcttcccctacagcatccccgccaccctcctggtgtggcacacctggcagaagcagacccagcgctccggcgtcctgtgggacgtgcccagcccgcccgagacgcagaaggccgagctcgaggagggggtgtaccggatcaagcagcagggcatcttcgggaagacccaggtcggcgtgggggtgcagaaggagggcgtcttccacaccatgtggcacgtgacccgcggcgccgtgctgacgcacaacgggaagcggctggagcccaactgggcgtccgtcaagaaggacctcatcagctacggcgggggctggcgcctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtggggctgtacggcaacggggtcgtgaccaagaacggcgggtacgtgtccggcatcgcccagaccaacgccgagcccgacggccccacgcccgagctcgaggaggagatgttcaagaagcgcaacctgaccatcatggacctgcacccggggagcggcaagacccggaagtacctccccgccatcgtccgcgaggccatcaagcggcgcctgcggaccctgatcctcgcgcccacgcgcgtggtggccgccgagatggaggaggccctgaaggggctgcccatccggtaccagaccaccgccaccaagtccgagcacacgggccgcgagatcgtcgacctcatgtgccacgcgaccttcaccatgcggctgctgagcccggtgcgcgtgcccaactacaacctcgtcatcatggacgaggcccacttcaccgaccccgcctccatcgccgcccgggggtacatcagcacgcgcgtgggcatgggcgaggcggccgccatcttcatgaccgccacgccgcccgggaccgcggaggccttcccccagtccaacgcccccatccaggacgaggagcgggacatccccgagcgcagctggaactccggcaacgagtggatcacggacttcgtggggaagaccgtctggttcgtgcccagcatcaaggccggcaacgacatcgccaactgcctgcgcaagaacgggaagaaggtgatccagctgtcccggaagaccttcgacaccgagtaccagaagacgcgcctcaacgactgggacttcgtcgtgaccaccgacatcagcgagatgggcgcgaacttcaaggccgaccgggtgatcgacccccgccggtgcctgaagcccgtcatcctgaccgacggccccgagcgcgtgatcctcgccgggccgatgcccgtgacggccgcctccgcggcccagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagaccttcgtggagctcatgcgccgcggggacctgcccgtctggctggcccacaaggtggccagcgagggcatcaagtacacggaccgcaagtggtgcttcgacggggagcggaacaaccagatcctcgaggagaacatggacgtggagatctggaccaaggagggcgagcgcaagaagctgcggccgcgctggctggacgcgcgcacctactccgaccccctcgccctgaaggagttcaaggacttcgccgccggccgcaagagcatcgccctggacctcgtcaccgagatcgggcgcgtgccctcccacctggcgcaccggacgcgcaacgccctggacaacctcgtgatgctgcacaccagcgagcacggcgggcgggcctaccgccacgccgtcgaggagctgccggagaccatggagaccctcctgctgctcggcctgatgatcctgctcaccggcggggccatgctgttcctgatcagcgggaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcggaccccgcaggacaaccagctcgcctacgtcgtgatcgggatcctgaccctggccgcgatcgtggccgccaacgagatgggcctcctggagacgaccaagcgcgacctgggcatgtccaaggagcccggggtcgtgagccccacctcctacctcgacgtggacctgcaccccgccagcgcctggaccctgtacgcggtcgccacgaccgtgatcaccccgatgctccggcacaccatcgagaactccacggccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacccactacgccatcatcggcccgggcctgcaggccaaggccacgcgcgaggcccagaagcggaccgcggccgggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcgcacgagctgggccctgtgcgaggccctgaccctcgcgaccggccccatcaccacgctgtgggagggctccccggggaagttctggaacaccaccatcgccgtgagcatggccaacatcttccggggctcctacctggccggggcgggcctcgccttcagcatcatgaagtccgtcgggaccggccgccggggcacggggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagaccacgcaccacgccgtgagccggggctccgccaagctccagtggttcgtcgagcgcaacatggtgatccccgaggggcgggtgatcgacctgggctgcgggcgcggcgggtggagctactactgcgcgggcctgaagaaggtcaccgaggtgcgcggctacaccaagggcggccccgggcacgaggagcccgtgccgatgtccacctacggctggaacatcgtcaagctcatgagcgggaaggacgtgttctacctgccgcccgagaagtgcgacacgctgctgtgcgacatcggcgagtccagcccctccccgaccgtggaggagagccggaccatccgcgtcctcaagatggtggagccctggctgcggaacaaccagttctgcatcaaggtgctgaacccctacatgcccaacgtcatcgagcacctcgagcgcctgcagcggaagtacggcgggatgctggtgcgcaacccgctctcccggaacagcacccacgagatgtactggatctccaacggcacggggaacatcgtgagctccgtcaacatggtgagccgcctgctgctcaaccggttcaccatgacccaccgccggcccaccatcgagaaggacgtcgacctgggcgccggcacgcgccacgtgaacgccgagcccgagaccccgaacatggacgtgatcggggagcggatcaagcgcatcaaggaggagcactccagcacctggcactacgacgacgagaacccctacaagacctgggcctaccacggctcctacgaggtcaaggccacggggagcgcgagctccatgatcaacggcgtggtgaagctgctcaccaagccctgggacgtcgtgcccatggtgacccagatggccatgaccgacacgaccccgttcgggcagcagcgggtcttcaaggagaaggtggacacccgcacgccccggcccatgcccggcacgcgcaaggtgatggagatcaccgccgagtggctgtggcggaccctgggccgcaacaagaagccgcgcctctgcacccgggaggagttcacgaagaaggtccgcaccaacgccgccatgggggcggtgttcaccgaggagaaccagtgggacagcgcccgggccgccgtggaggacgaggagttctggaagctggtcgacaaggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggttcctcgagttcgaggccctgggcttcctgaacgaggaccactggttctcccgcgagaacagctactccggggtggagggcgaggggctccacaagctgggctacatcctgcgggacatcagcaagatccccggcggggccatgtacgcggacgacaccgccggctgggacacgcgcatcaccgaggacgacctccacaacgaggagaagatcacccagcagatggaccccgagcaccggcagctggccaacgccatcttcaagctgacctaccagaacaaggtcgtgaaggtgcagcgccccacgccgaaggggaccgtcatggacatcatctcccggaaggaccagcgcggcagcggccaggtggggacctacggcctcaacaccttcaccaacatggaggcccagctggtgcggcagatggagggggagggcgtcctgtccgaggcggacctcgagaacccccacctcctggagaagaagatcacgcagtggctcgagaccaagggggtggagcgcctgaagcggatggccatcagcggcgacgactgcgtggtcaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtcgtgccctgccggccccaggacgagctgatcgggcgcgcgcgcatctcccagggcgccgggtggagcctgaaggagaccgcctgcctcggcaaggcctacgcccagatgtggtccctgatgtacttccaccggcgcgacctgcggctcgcgagcaacgccatctgctccgccgtgccggtccactggatccccaccagccgcacgacctggagcatccacgcccaccaccagtggatgaccaccgaggacatgctgacggtgtggaaccgggtgtggatcgaggacaacccctggatgggcgacaagacccccgtcaccacctgggaggacgtgccgtacctggggaagcgcgaggaccagtggtgcggctccctcatcgggctgacgagccgggcgacctgggcccagaacatcctgaccgccatccagcaggtccgctccctcatcggcgacgaggagttcctggactacatgcccagcatgaagcggttccgcaaggaggaggagtccgagggggccatctggtga

SEQ ID NO: 9937 - RNA, 9873 nt, synthetic construct
  misc_feature 1..9873: note = derived and/or modified CDS sequence (opt1) from DENV-3__GU131915__SS-prME
  source 1..9873: mol_type = other RNA
accagcctgtgcctcatgatgatgctgcccgccaccctggccttccacctcaccagccgcgacggcgagccgcggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggccgagcccgaggacatcgactgctggtgcaacctcaccagcacctgggtgacctacgggacctgcaaccaggccggcgagcaccggcgcgacaagcggtccgtggcgctggcgccccacgtgggcatggggctggacacccgcacccagacctggatgagcgccgagggcgcctggcgccaggtggagaaggtggagacgtgggcgctccgccacccggggttcaccatcctggccctgttcctcgcccactacatcggcacctccctgacccagaaggtggtgatcttcatcctgctcatgctggtgacgcccagcatgaccatgcggtgcgtcggggtgggcaaccgcgacttcgtggagggcctgtccggggccacctgggtcgacgtggtgctcgagcacggcgggtgcgtcaccacgatggccaagagcaagcccaccctggacatcgagctgcagaagaccgaggcgacccagctcgccacgctgcggaagctgtgcatcgagggcaagatcaccaacatcaccaccgactcccgctgccccacgcagggcgaggccaccctcccggaggagcaggaccagaactacgtgtgcaagcacacctacgtggaccgggggtggggcaacgggtgcggcctgttcgggaagggcagcctggtgacctgcgccaagttccagtgcctcgagcccatcgagggcaaggtggtgcagcacgagaacctgaagtacacggtcatcatcaccgtgcacaccggggaccagcaccaggtgggcaacgacacccagggggtcacggtggagatcacgccccaggcctccaccgtcgaggcggtgctgcccgagtacggcaccctcgggctggagtgcagcccgcgcaccggcctggacttcaacgagatgatcctcctgacgatgaagaacaaggcctggatggtgcaccggcagtggttcttcgacctgcccctcccctggacctccggcgccaccaccgagacgcccacctggaaccgcaaggagctgctggtcaccttcaagaacgcccacgccaagaagcaggaggtggtggtcctcgggagccaggagggcgcgatgcacaccgccctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtgagcgagacgcagcacgggaccatcctgatcaaggtcgagtacaagggcgaggacgcgccgtgcaagatccccttcagcaccgaggacgggcagggcaaggcccactccggccgcctgatcaccgccaaccccgtggtgacgaagaaggaggagcccgtcaacatcgaggccgagccgcccttcggggagagcaacatcgtgatcggcatcggggacaaggcgctcaagatcaactggtacaagaagggctccagcatcgggaagatgttcgaggccaccgcccggggcgcccgccggatggccatcctgggcgacaccgcgtgggacttcgggtccgtgggcggggtcctgaacagcctcggcaagatggtgcaccagatcttcgggtccgcctacaccgccctgttcagcggcgtgtcctggatcatgaagatcggcatcggggtcctgctcacgtggatcggcctgaacagcaagaacacctccatgagcttctcctgcatcgtgatcgggatcatcaccctgtacctcggcgccgtggtccaggccgacatggggtgcgtgatcaactggaagggcaaggagctgaagtgcggcagcgggatcttcgtgaccaacgaggtccacacgtggaccgagcagtacaagttccaggcggactcccccaagcgcctggccaccgccatcgccggcgcctgggagaacggggtgtgcggcatccgcagcaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtactcctggaagacgtgggggaaggccaagatcgtcaccgccgagacccagaacagctccttcatcatcgacggccccaacacccccgagtgccccagcgccagccgggcgtggaacgtgtgggaggtggaggactacgggttcggcgtcttcacgaccaacatctggctgaagctccgcgaggtgtacacccagtcctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacacgctctggtccaacggcgtgctggagagcgacatgatcatccccaagtccctggccgggcccatcagccagcacaaccaccggccgggctaccacacccagaccgccgggccctggcacctcggcaagctggagctggacttcaactactgcgagggcaccacggtggtcatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcacgttcgtgctcctgctgtccggccagatcacctggcgcgacatggcccacaccctcatcatgatcggcagcaacgccagcgaccggatggggatgggcgtcacctacctggccctgatcgccacgttcaagatccagcccttcctcgcgctggggttcttcctgcgcaagctcacctcccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgagcctgacgtgctccaacaccatcttcaccctgaccgtcgcctggcgcacggccaccctcatcctggccggggtgagcctgctcccgctgtgccagtccagctccatgcggaagaccgactggctgcccatgaccgtcgcggccatgggcgtgccgcccctgccgctgttcatcttcagcctgaaggacacgcccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcaccgggacctccgccgacctgaccgtggagaaggccgccgacgtcacgtgggaggaggaggcggagcagaccggggtgagccacaacctcatgatcaccgtggacgacgacgggaccatgcgcatcaaggacgacgagaccgagaacatcctgacggtcctgctcaagaccgccctgctgatcgtgtccggcatcttcccctacagcatccccgccaccctcctggtgtggcacacctggcagaagcagacgcagcggtccggcgtcctgtgggacgtgcccagcccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagcccaactgggcgtccgtcaagaaggacctcatcagctacggcgggggctggcggctgaacgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggctccccgatcatcaaccgcgagggcaaggtggtggggctgtacggcaacggggtcgtgaccaagaacggcgggtacgtgagcggcatcgcccagacgaacgccgagcccgacggccccacccccgagctcgaggaggagatgttcaagaagcggaacctgaccatcatggacctgcacccggggtccggcaagacccgcaagtacctccccgccatcgtccgggaggccatcaagcgccggctgcgcacgctgatcctcgcgcccacccgggtggtggccgccgagatggaggaggccctgaaggggctgcccatccgctaccagaccaccgccaccaagagcgagcacaccggccgggagatcgtcgacctcatgtgccacgcgaccttcaccatgcgcctgctgtccccggtgcgggtgcccaactacaacctcgtcatcatggacgaggcccacttcacggaccccgccagcatcgccgcccgcgggtacatctccacccgggtgggcatgggcgaggcggccgccatcttcatgaccgccacgccgcccgggacggcggaggccttcccccagagcaacgcccccatccaggacgaggagcgcgacatccccgagcgctcctggaacagcggcaacgagtggatcaccgacttcgtggggaagaccgtctggttcgtgccctccatcaaggccggcaacgacatcgccaactgcctgcggaagaacgggaagaaggtgatccagctgagccgcaagaccttcgacacggagtaccagaagacccggctcaacgactgggacttcgtcgtgaccaccgacatctccgagatgggcgcgaacttcaaggccgaccgcgtgatcgacccccggcgctgcctgaagcccgtcatcctgacggacggccccgagcgggtgatcctcgccgggccgatgcccgtgaccgccgccagcgcggcccagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagagccgcaagacgttcgtggagctcatgcggcgcggggacctgcccgtctggctggcccacaaggtggcctccgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcgcggacctacagcgaccccctcgccctgaaggagttcaaggacttcgccgccggccgcaagtccatcgccctggacctcgtcacggagatcgggcgggtgcccagccacctggcgcaccgcacccggaacgccctggacaacctcgtgatgctgcacaccagcgagcacggcgggcgcgcctaccggcacgccgtcgaggagctgccggagaccatggagacgctcctgctgctcggcctgatgatcctgctcaccgggggcgccatgctgttcctgatctccggcaaggggatcggcaagaccagcatcgggctcatctgcgtgatcgtgtccagcggcatgctgtggatggcggacgtccccctgcagtggatcgcctccgccatcgtgctcgagttcttcatgatggtgctgctgatccccgagcccgagaagcagcgcaccccgcaggacaaccagctcgcctacgtcgtgatcgggatcctgacgctggccgcgatcgtggccgccaacgagatgggcctcctggagaccaccaagcgggacctgggcatgagcaaggagcccggggtcgtgtcccccaccagctacctcgacgtggacctgcaccccgcctccgcctggacgctgtacgcggtcgccaccaccgtgatcaccccgatgctccgccacacgatcgagaacagcaccgccaacgtgtccctggccgcgatcgccaaccaggccgtcgtgctgatgggcctcgacaaggggtggcccatcagcaagatggacctgggcgtgcccctgctcgccctggggtgctactcccaggtcaaccccctgaccctcaccgccgcggtgctgctgctcgtgacgcactacgccatcatcggcccgggcctgcaggccaaggccacccgggaggcccagaagcgcaccgcggccgggatcatgaagaaccccaccgtcgacggcatcatgacgatcgacctggaccccgtgatctacgacagcaagttcgagaagcagctcggccaggtgatgctgctggtcctctgcgccgtgcagctgctgctcatgcggacctcctgggccctgtgcgaggccctgaccctcgcgaccggccccatcacgaccctgtgggagggcagcccggggaagttctggaacaccaccatcgccgtgtccatggccaacatcttccgcggcagctacctggccggggcgggcctcgccttctccatcatgaagtccgtcgggacgggccggcgcggcaccgggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagacgacccaccacgccgtgtcccgcggcagcgccaagctccagtggttcgtcgagcggaacatggtgatccccgaggggcgcgtgatcgacctgggctgcgggcgcggcgggtggtcctactactgcgcgggcctgaagaaggtcaccgaggtgcggggctacaccaagggcgggcccgggcacgaggagcccgtgccgatgagcacgtacggctggaacatcgtcaagctcatgtccgggaaggacgtgttctacctgccgcccgagaagtgcgacaccctgctgtgcgacatcggcgagagctcccccagcccgaccgtggaggagtcccgcaccatccgggtcctcaagatggtggagccctggctgcgcaacaaccagttctgcatcaaggtgctgaacccctacatgcccacggtcatcgagcacctcgagcggctgcagcgcaagtacggcgggatgctggtgcggaacccgctcagccgcaactccacccacgagatgtactggatcagcaacggcaccgggaacatcgtgtccagcgtcaacatggtgtcccggctgctgctcaaccgcttcaccatgacgcaccggcgccccaccatcgagaaggacgtcgacctgggcgccggcacccggcacgtgaacgccgagcccgagaccccgaacatggacgtgatcggggagcgcatcaagcggatcaaggaggagcacagctccacgtggcactacgacgacgagaacccctacaagacctgggcctaccacggcagctacgaggtcaaggccaccgggagcgcgtccagcatgatcaacggcgtggtgaagctgctcaccaagccctgggacgtcgtgcccatggtgacgcagatggccatgaccgacaccaccccgttcgggcagcagcgcgtcttcaaggagaaggtggacacgcggacgccccggcccatgcccggcacccggaaggtgatggagatcaccgccgagtggctgtggcgcacgctgggccgcaacaagaagccgcggctctgcacccgcgaggagttcaccaagaaggtccggaccaacgccgccatgggggcggtgttcacggaggagaaccagtgggactccgcccgcgccgccgtggaggacgaggagttctggaagctggtcgaccgggagcgcgagctgcacaagctcggcaagtgcgggagctgcgtgtacaacatgatgggcaagcgggagaagaagctgggggagttcggcaaggcgaagggctcccgcgccatctggtacatgtggctgggggcccggtacctcgagttcgaggccctgggcttcctgaacgaggaccactggttcagccgcgagaactcctacagcggggtggagggcgaggggctccacaagctgggctacatcctgcgggacatctccaagatccccggcggggccatgtacgcggacgacaccgccggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccaccccgaaggggaccgtcatggacatcatcagccggaaggaccagcgcggctccggccaggtggggacctacggcctcaacacgttcaccaacatggaggcccagctggtgcggcagatggagggggagggcgtcctgagcaaggcggacctcgagaacccccacctcctggagaagaagatcacccagtggctcgagaccaagggggtggagcgcctgaagcggatggccatctccggcgacgactgcgtggtcaagcccatcgacgaccgcttcgccaacgccctgctcgccctgaacgacatgggcaaggtgcggaaggacatcccccagtggcagccgagcaaggggtggcacgactggcagcaggtccccttctgctcccaccacttccacgagctgatcatgaaggacggccgcaagctcgtcgtgccctgccgcccccaggacgagctgatcgggcgggcgcgcatcagccagggcgccgggtggtccctgaaggagacggcctgcctcggcaaggcctacgcccagatgtggagcctgatgtacttccaccggcgcgacctgcggctcgcgtccaacgccatctgcagcgccgtgccggtccactggatccccaccagccgcaccacctggtccatccacgcccaccaccagtggatgacgaccgaggacatgctgaccgtgtggaaccgggtgtggatcgaggacaacccctggatggaggacaagacccccgtcacgacctgggaggacgtgccgtacctgggcaagcgcgaggaccagtggtgcgggagcctcatcggcctgacctcccgggcgacctgggcccagaacatcctgacggccatccagcaggtccgcagcctcatcggggacgaggagttcctggactacatgccctccatgaagcggttccgcaaggaggaggagagcgagggcgccatctggtga

SEQ ID NO: 9938 - RNA, 9873 nt, synthetic construct
  misc_feature 1..9873: note = derived and/or modified CDS sequence (opt1) from DENV-3__GU131916__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggcgaagatcgtgaccgccgagacccagaactccagcttcatcatcgacggccccaacacccccgagtgcccctccgccagccgggcctggaacgtgtgggaggtcgaggactacgggttcggcgtgttcacgaccaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcacgttcgtcctcctgctgagcggccagatcacctggcgcgacatggcgcacaccctcatcatgatcggctccaacgccagcgaccggatggggatgggcgtgacctacctggccctgatcgccacgttcaagatccagcccttcctcgccctggggttcttcctgcgcaagctcaccagccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtctccctgacgtgcagcaacaccatcttcaccctgaccgtggcctggcgcacggccaccctcatcctggccggggtctccctgctcccgctgtgccagagctccagcatgcggaagaccgactggctgcccatgaccgtggccgcgatgggcgtgccgcccctgccgctgttcatcttctccctgaaggacacgcccaagcgccgcagctggcccctcaacgagggggtcatggccgtgggcctggtgtccatcctggccagctccctcctgcggaacgacgtccccatggccggcccgctggtggccgggggcctcctgatcgcgtgctacgtgatcaccgggaccagcgccgacctgaccgtcgagaaggccgccgacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgcgctgctgatcgtgagcggcatcttcccctactccatccccgccaccctcctggtctggcacacctggcagaagcagacgcagcggagcggcgtgctgtgggacgtgccctccccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggccagcgtgaagaaggacctcatctcctacggcgggggctggcggctgagcgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggctccccgatcatcaaccgcgagggcaaggtggtcgggctgtacggcaacggggtgatcaccaagaacggcgggtacgtgagcggcatcgcgcagacgaacgccgagcccgacggccccacccccgagctcgaggaggagatgttcaagaagcggaacctgaccatcatggacctgcacccggggtccggcaagacccgcaagtacctccccgccatcgtccgggaggccatcaagcgccggctgcgcacgctgatcctcgcccccacccgggtggtggcggccgagatggaggaggccctgaaggggctgcccatccgctaccagaccaccgccaccaagagcgagcacaccggccgggagatcgtcgacctcatgtgccacgccaccttcaccatgcgcctgctgtccccggtgcgggtgcccaactacaacctcgtcatcatggacgaggcgcacttcacggaccccgccagcatcgccgcccgcgggtacatctccacccgggtgggcatgggcgaggccgcggccatcttcatgaccgccacgccgcccgggacggccgaggcgttcccccagagcaacgcccccatccaggacgaggagcgcgacatccccgagcgctcctggaacagcggcaacgagtggatcaccgacttcgtggggaagaccgtctggttcgtgccctccatcaaggccggcaacgacatcgccaactgcctgcggaagaacgggaagaaggtgatccagctgagccgcaagaccttcgacacggagtaccagaagacccggctcaacgactgggacttcgtcgtgaccaccgacatctccgagatgggcgccaacttcaaggcggaccgcgtgatcgacccccggcgctgcctgaagcccgtcatcctgacggacggccccgagcgggtgatcctcgccgggccgatgcccgtgaccgccgccagcgccgcgcagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagagccgcaagacgttcgtggagctcatgcggcgcggggacctgcccgtctggctggcccacaaggtggcctccgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcccggacctacagcgaccccctcgcgctgaaggagttcaaggacttcgccgccggccgcaagtccatcgccctggacctcgtcacggagatcgggcgggtgcccagccacctggcccaccgcacccggaacgcgctggacaacctcgtgatgctgcacaccagcgagcacggcgggcgcgcctaccggcacgccgtcgaggagctgccggagaccatggagacgctcctgctgctcggcctgatgatcctgctcacctccggggccatgctgttcctgatcagcggcaagggcatcgggaagacctccatcggcctcatctgcgtgatcgtgagctccgggatgctgtggatggccgacgtccccctgcagtggatcgcgagcgccatcgtgctcgagttcttcatgatggtgctgctgatccccgagcccgagaagcagcgcaccccgcaggacaaccagctcgcctacgtcgtgatcggcatcctgacgctggccgccatcgtggcggccaacgagatggggctcctggagaccaccaagcgggacctgggcatgtccaaggagcccggcgtcgtgagccccacctcctacctcgacgtggacctgcaccccgccagcgcctggacgctgtacgccgtcgcgaccaccgtgatcaccccgatgctccgccacacgatcgagaactccaccgccaacgtgagcctggccgccatcgcgaaccaggccgtcgtgctgatggggctcgacaagggctggcccatctccaagatggacctgggggtgcccctgctcgccctgggctgctacagccaggtcaaccccctgaccctcaccgccgccgtgctgctgctcgtgacgcactacgcgatcatcgggccgggcctgcaggccaaggccacccgggaggcccagaagcgcaccgccgcgggcatcatgaagaaccccaccgtcgacgggatcatgacgatcgacctggaccccgtgatctacgactccaagttcgagaagcagctcggccaggtgatgctgctggtcctctgcgccgtgcagctgctgctcatgcggaccagctgggccctgtgcgaggccctgaccctcgccaccgggcccatcacgaccctgtgggagggctccccgggcaagttctggaacaccaccatcgcggtgagcatggccaacatcttccgcgggtcctacctggccggcgccgggctcgcgttcagcatcatgaagtccgtcggcacggggcggcgcggcaccggctcccagggggagaccctgggcgagaagtggaagaagaagctgaaccagctcagccggaaggagttcgacctgtacaagaagtccgggatcaccgaggtggaccgcaccgaggccaaggagggcctgaagcgcggggagacgacccaccacgccgtgagccgcggctccgccaagctccagtggttcgtcgagcggaacatggtgatccccgagggccgcgtgatcgacctggggtgcggccgcgggggctggagctactactgcgccgggctgaagaaggtcaccgaggtgcggggctacaccaagggcgggcccggccacgaggagcccgtgccgatgtccacgtacgggtggaacatcgtcaagctcatgagcggcaaggacgtgttctacctgccgcccgagaagtgcgacaccctgctgtgcgacatcggggagtccagcccctccccgaccgtggaggagagccgcaccatccgggtcctcaagatggtggagccctggctgcgcaacaaccagttctgcatcaaggtgctgaacccctacatgcccacggtcatcgagcacctcgagcggctgcagcgcaagtacggcggcatgctggtgcggaacccgctctcccgcaacagcacccacgagatgtactggatctccaacgggaccggcaacatcgtgagctccgtcaacatggtgagccggctgctgctcaaccgcttcaccatgacgcaccggcgccccaccatcgagaaggacgtcgacctgggggcgggcacccggcacgtgaacgccgagcccgagaccccgaacatggacgtgatcggcgagcgcatcaagcggatcaaggaggagcactccagcacgtggcactacgacgacgagaacccctacaagacctgggcctaccacgggagctacgaggtcaaggccaccggctccgccagctccatgatcaacggggtggtgaagctgctcaccaagccctgggacgtcgtgcccatggtgacgcagatggcgatgaccgacaccaccccgttcggccagcagcgcgtcttcaaggagaaggtggacacgcggacgccccggcccatgcccgggacccggaaggtgatggagatcaccgccgagtggctgtggcgcacgctgggccgcaacaagaagccgcggctctgcacccgcgaggagttcaccaagaaggtccggaccaacgccgccatgggcgccgtgttcacggaggagaaccagtgggacagcgcgcgcgccgccgtggaggacgaggagttctggaagctggtcgaccgggagcgcgagctgcacaagctcgggaagtgcggctcctgcgtgtacaacatgatggggaagcgggagaagaagctgggcgagttcgggaaggccaagggcagccgcgcgatctggtacatgtggctgggcgcccggtacctcgagttcgaggccctggggttcctgaacgaggaccactggttctcccgcgagaacagctactccggcgtggagggggagggcctccacaagctggggtacatcctgcgggacatcagcaagatccccggcggcgccatgtacgccgacgacaccgcggggtgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccaccccgaagggcaccgtcatggacatcatctcccggaaggaccagcgcgggagcggccaggtgggcacctacgggctcaacacgttcaccaacatggaggcccagctggtgcggcagatggagggcgaggacgtcctgtccaaggccgacctcgagaacccccacctcctggagaagaagatcacccagtggctcgagaccaagggggtggagcgcctgaagcggatggcgatcagcggcgacgactgcgtggtcaagcccatcgacgaccgcttcgccaacgccctgctcgccctgaacgacatggggaaggtgcggaaggacatcccccagtggcagccgtccaagggctggcacgactggcagcaggtccccttctgcagccaccacttccacgagctgatcatgaaggacggccgcaagctcgtcgtgccctgccgcccccaggacgagctgatcgggcgggcccgcatctcccagggcgcggggtggagcctgaaggagacggcctgcctcggcaaggcctacgcccagatgtggtccctgatgtacttccaccggcgcgacctgcggctcgccagcaacgcgatctgcagcgccgtgccggtccactggatccccacctcccgcaccacctggagcatccacgcccaccaccagtggatgacgaccgaggacatgctgaccgtgtggaaccgggtgtggatcgaggacaacccctggatggaggacaagacccccgtcacgacctgggaggacgtgccgtacctggggaagcgcgaggaccagtggtgcggctccctcatcggcctgaccagccgggccacctgggcgcagaacatcctgacggccatccagcaggtccgctccctcatcggggacgaggagttcagcgactacatgccctccatgaagcggttccgcaaggaggaggagagcgagggcgccatctggtga

SEQ ID NO: 9939 - RNA, 9873 nt, synthetic construct
  misc_feature 1..9873: note = derived and/or modified CDS sequence (opt1) from DENV-3__GU131917__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcacgctgctcatgctggtcacccccagcatgaccatgcggtgcgtgggggtgggcaaccgcgacttcgtcgagggcctgtccggggccacctgggtggacgtggtcctcgagcacggcgggtgcgtgacgaccatggccaagagcaagcccaccctggacatcgagctgcagaagaccgaggccacgcagctcgcgaccctgcggaagctgtgcatcgagggcaagatcaccaacatcaccacggactcccgctgccccacccagggcgaggccaccctcccggaggagcaggaccagaactacgtgtgcaagcacacctacgtcgaccgggggtggggcaacgggtgcggcctgttcgggaagggcagcctggtgacgtgcgccaagttccagtgcctcgagcccatcgagggcaaggtggtccagtacgagaacctgaagtacaccgtgatcatcaccgtgcacaccggggaccagcaccaggtcggcaacgacacgcagggggtgaccgtcgagatcacgccccaggcctccaccgtggaggccgtgctgcccgagtacggcaccctcgggctggagtgcagcccgcgcacgggcctggacttcaacgagatgatcctcctgaccatgaagaacaaggcgtggatggtccaccggcagtggttcttcgacctgcccctcccctggacctccggcgccaccacggagacccccacctggaaccgcaaggagctgctggtgaccttcaagaacgcccacgccaagaagcaggaggtggtcgtgctcgggagccaggagggcgccatgcacacggcgctgaccggggccaccgagatccagaactccggcgggaccagcatcttcgccggccacctgaagtgccggctcaagatggacaagctggagctgaagggcatgtcctacgccatgtgcctcaacacgttcgtgctgaagaaggaggtcagcgagacccagcacgggaccatcctgatcaaggtggagtacaagggcgaggacgccccgtgcaagatccccttcagcaccgaggacgggcagggcaaggcgcacaacggccgcctgatcacggccaaccccgtggtcaccaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacacggccctgttctccggcgtcagctggatcatgaagatcggcatcggggtgctgctcacctggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggcaacgggatcttcgtcacgaacgaggtgcacacctggaccgagcagtacaagttccaggccgactcccccaagcgcctggcgaccgccatcgccggcgcctgggagaacggggtgtgcggcatccgcagcacgacccggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacgtggcccaagagccacaccctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcacgaccgtcgtgatcgccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcacgttcgtcctcctgctgtccggccagatcacctggcgcgacatggcccacaccctcatcatgatcggcagcaacgcctccgaccggatggggatgggcgtgacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtcagcctgacgtgctccaacaccatcttcaccctgaccgtggcctggcgcacggccaccctcatcctggccggggtcagcctgctcccgctgtgccagtccagctccatgcggaagaccgactggctgcccatgaccgtggcggccatgggcgtgccgcccctgccgctgttcatcttcagcctgaaggacacgcccaagcgccgctcctggcccctcaacgagggggtcatggccgtgggcctggtgagcatcctggcctccagcctcctgcggaacgacgtccccatggccggcccgctggtggccggcgggctcctgatcgcctgctacgtgatcaccgggacctccgccgacctgaccgtcgagaaggccgccgacgtgacgtgggaggaggaggcggagcagaccggggtgagccacaacctcatgatcaccgtcgacgacgacgggaccatgcgcatcaaggacgacgagaccgagaacatcctgacggtgctgctcaagaccgccctgctgatcgtgtccggcatcttcccctacagcatccccgccaccctcctggtctggcacacctggcagaagcagacgcagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggcgtccgtgaagaaggacctcatcagctacggcgggggctggcggctgtccgcccagtggcagaagggggaggaggtgcaggtcatcgccgtggagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtcgggctgtacggcaacggggtggtgaccaagaacggcgggtacgtctccggcatcgcccagacgaacgccgagcccgacggccccacccccgagctcgaggaggagatgttcaagaagcggaacctgaccatcatggacctgcacccggggagcggcaagacccgcaagtacctccccgccatcgtgcgggaggccatcaagcgccggctgcgcacgctgatcctcgcgcccacccgggtggtcgccgccgagatggaggaggccctgaaggggctgcccatccgctaccagaccaccgccacgaagtccgagcacaccggccgggagatcgtggacctcatgtgccacgcgaccttcaccatgcgcctgctgagcccggtgcgggtccccaactacaacctcgtgatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgccaactgcctgcggaagaacgggaagaaggtcatccagctgtcccgcaagaccttcgacacggagtaccagaagacccggctcaacgactgggacttcgtggtgaccaccgacatcagcgagatgggcgcgaacttcaaggccgaccgcgtcatcgacccccggcgctgcctgaagcccgtgatcctgacggacggccccgagcgggtgatcctcgccgggccgatgcccgtcaccgccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgacggagatcgggcgggtgccctcccacctggcgcaccgcacccggaacgccctggacaacctcgtcatgctgcacaccagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgacgctggccgcgatcgtcgccgccaacgagatgggcctcctggagaccaccaagcgggacctgggcatgtccaaggagcccggggtggtgagccccacctcctacctcgacgtcgacctgcaccccgccagcgcctggacgctgtacgcggtggccaccaccgtgatcaccccgatgctccgccacacgatcgagaactccaccgccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacgcactacgccatcatcggcccgggcctgcaggccaaggccacccgggaggcccagaagcgcaccgcggccgggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgcgaccggccccatcacgaccctgtgggagggctccccggggaagttctggaacaccaccatcgccgtcagcatggccaacatcttccgcggctcctacctggccggggcgggcctcgccttcagcatcatgaagtccgtggggacgggcaagcggggcaccgggagccagggcgagaccctgggggagaagtggaagaagaagctgaaccagctcagccgcaaggagttcgacctgtacaagaagtccggcatcaccgaggtggaccggagcgaggccaaggaggggctgaagcgcggcgagaccacgcaccacgccgtctcccggggcagcgccaagctccagtggttcgtggagcgcaacatggtgatccccgaggggcgggtcatcgacctgggctgcgggcgcggcgggtggtcctactactgcgcgggcctgaagaaggtgaccgaggtgcgcggctacaccaagggcggccccgggcacgaggagcccgtcccgatgagcacctacggctggaacatcgtgaagctcatgtccgggaaggacgtgttctacctgccgcccgagaagtgcgacacgctgctgtgcgacatcggcgagagctcccccagcccgaccgtcgaggagtcccggaccatccgcgtgctcaagatggtggagccctggctgcggaacaaccagttctgcatcaaggtcctgaacccctacatgcccaccgtgatcgagcacctcgagcgcctgcagcggaagtacggcgggatgctggtgcgcaacccgctcagccggaactccacgcacgagatgtactggatcagcaacggcaccgggaacatcgtctccagcgtgaacatggtctcccgcctgctgctcaaccggttcaccatgacccaccgccggcccacgatcgagaaggacgtggacctgggcgccggcacccgccacgtgaacgccgagcccgagaccccgaacatggacgtcatcggggagcggatcaagcgcatcaaggaggagcacagctccacctggcactacgacgacgagaacccctacaagacgtgggcctaccacggcagctacgaggtgaaggccaccgggagcgcgtccagcatgatcaacggcgtggtcaagctgctcaccaagccctgggacgtggtgcccatggtcacccagatggccatgacggacaccaccccgttcgggcagcagcgggtgttcaaggagaaggtggacacccgcacgccccggcccatgcccggcacccgcaaggtcatggagatcaccgccgagtggctgtggcggaccctgggccgcaacaagaagccgcgcctctgcacgcgggaggagttcaccaagaaggtgcgcaccaacgccgccatgggggcggtgttcaccgaggagaaccagtgggactccgcccgggccgccgtcgaggacgaggagttctggaagctggtggacaaggagcgcgagctgcacaagctcggcaagtgcgggagctgcgtgtacaacatgatgggcaagcgggagaagaagctgggggagttcggcaaggcgaagggctcccgcgccatctggtacatgtggctgggggcccggtacctcgagttcgaggccctgggcttcctgaacgaggaccactggttcagccgcgagaactcctacagcggggtcgagggcgaggggctccacaagctgggctacatcctgcgggacatctccaagatccccggcggggccatgtacgcggacgacacggccggctgggacacccgcatcaccgaggacgacctccacaacgaggagaagatcacccagcagatggaccccgagcaccggcagctggccaacgccatcttcaagctgacgtaccagaacaaggtggtgaaggtccagcgccccaccccgaaggggaccgtgatggacatcatcagccggaaggaccagcgcggctccggccaggtggggacctacggcctcaacaccttcacgaacatggaggcccagctggtccggcagatggagggggagggcgtgctgagcaaggcggacctcgagaacccccacctcctggagaagaagatcatccagtggctcgagaccaagggggtggagcgcctgaagcggatggccatctccggcgacgactgcgtcgtgaagcccatcgacgaccgcttcgccaacgccctgctcgccctgaacgacatgggcaaggtgcggaaggacatcccccagtggcagccgagcaaggggtggcacgactggcagcaggtccccttctgctcccaccacttccacgagctgatcatgaaggacggccgcaagctcgtggtgccctgccggccccaggacgagctgatcgggcgcgcgcgcatcagccagggcgccgggtggtccctgaaggagaccgcctgcctcggcaaggcctacgcccagatgtggagcctgatgtacttccaccggcgcgacctgcggctcgcgtccaacgccatctgcagcgccgtcccggtgcactggatccccaccagccgcacgacctggtccatccacgcccaccaccagtggatgaccaccgaggacatgctgagcgtgtggaaccgggtctggatcgaggacaacccctggatggaggacaagacgcccgtgaccacctgggaggacgtgccgtacctgggcaagcgcgaggaccagtggtgcgggtccctcatcggcctgaccagccgggcgacgtgggcccagaacatcctgaccgccatccagcaggtccgctccctcatcggggacgaggagttcctggactacatgcccagcatgaagcggttccgcaaggaggaggagtccgagggcgccatctggtga

SEQ ID NO: 9940 - RNA, 9873 nt, synthetic construct
  misc_feature 1..9873: note = derived and/or modified CDS sequence (opt1) from DENV-3__GU131918__SS-prME
  source 1..9873: mol_type = other RNA
accagcctgtgcctcatgatgatgctgcccgccaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgcctcccgggcctggaacgtgtgggaggtcgaggactacgggttcggcgtgttcacgaccaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtcgtgatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcacgttcgtcctcctgctgtccggccagatcacctggcgcgacatggcgcacaccctcatcatgatcggcagcaacgcctccgaccggatggggatgggcgtgacctacctggccctgatcgccacgttcaagatccagcccttcctcgccctggggttcttcctgcgcaagctcaccagccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtcagcctgacgtgctccaacaccatcttcaccctgaccgtggcctggcgcacggccaccctcatcctggccggggtcagcctgctcccgctgtgccagtccagctccatgcggaagaccgactggctgcccatgaccgtggccgcgatgggcgtgccgcccctgccgctgttcatcttcagcctgaaggacacgcccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcaccgggacctccgccgacctgaccgtcgagaaggccgccgacgtgacgtgggaggaggaggccgagcagaccggcgtgagccacaacctcatgatcaccgtcgacgacgacgggaccatgcgcatcaaggacgacgagaccgagaacatcctgacggtgctgctcaagaccgcgctgctgatcgtgtccggcatcttcccctacagcatccccgccaccctcctggtctggcacacctggcagaagcagacgcagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggcctccgtgaagaaggacctcatcagctacggcgggggctggcggctgtccgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggcagcccgatcatcaaccgcgagggcaaggtggtcgggctgtacggcaacggggtggtgaccaagaacggcgggtacgtctccggcatcgcgcagacgaacgccgagcccgacggccccacccccgagctcgaggaggagatgttcaagaagcggaacctgaccatcatggacctgcacccggggagcggcaagacccgcaagtacctccccgccatcgtgcgggaggccatcaagcgccggctgcgcacgctgatcctcgcccccacccgggtggtcgcggccgagatggaggaggccctgaaggggctgcccatccgctaccagaccaccgccacgaagtccgagcacaccggccgggagatcgtggacctcatgtgccacgccaccttcaccatgcgcctgctgagcccggtgcgggtccccaactacaacctcgtgatcatggacgaggcgcacttcacggaccccgcctccatcgccgcccgcgggtacatcagcacccgggtgggcatgggcgaggccgcggccatcttcatgaccgccacgccgcccgggacggccgaggcgttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgccaactgcctgcggaagaacgggaagaaggtcatccagctgtcccgcaagaccttcgacacggagtaccagaagacccggctcaacgactgggacttcgtggtgaccaccgacatcagcgagatgggcgccaacttcaaggcggaccgcgtcatcgacccccggcgctgcctgaagcccgtgatcctgacggacggccccgagcgggtgatcctcgccgggccgatgcccgtcaccgccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagacgttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcccggacctactccgaccccctcgcgctgaaggagttcaaggacttcgccgccggccgcaagagcatcgccctggacctcgtgacggagatcgggcgggtgccctcccacctggcccaccgcacccggaacgcgctggacaacctcgtcatgctgcacaccagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtgatcgtcagctccggcatgctgtggatggccgacgtgcccctgcagtggatcgcgagcgccatcgtgctcgagttcttcatgatggtcctgctgatccccgagcccgagaagcagcgcaccccgcaggacaaccagctcgcctacgtggtgatcgggatcctgacgctggccgccatcgtcgcggccaacgagatgggcctcctggagaccaccaagcgggacctgggcatgtccaaggagcccggggtggtgagccccacctcctacctcgacgtcgacctgcaccccgccagcgcctggacgctgtacgccgtggcgaccaccgtgatcaccccgatgctccgccacacgatcgagaactccaccgccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacgcactacgcgatcatcggcccgggcctgcaggccaaggccacccgggaggcccagaagcgcaccgccgcggggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgccaccggccccatcacgaccctgtgggagggctccccggggaagttctggaacaccaccatcgcggtcagcatggccaacatcttccgcggctcctacctggccggggccggcctcgcgttcagcatcatgaagtccgtggggacgggcaagcggggcaccgggagccagggcgagaccctgggggagaagtggaagaagaagctgaaccagctcagccgcaaggagttcgacctgtacaagaagtccggcatcaccgaggtggaccggagcgaggccaaggaggggctgaagcgcggcgagaccacgcaccacgccgtctcccggggcagcgccaagctccagtggttcgtggagcgcaacatggtgatccccgaggggcgggtcatcgacctgggctgcgggcgcggcgggtggtcctactactgcgccggcctgaagaaggtgaccgaggtgcgcggctacaccaagggcgggcccgggcacgaggagcccgtcccgatgagcacctacggctggaacatcgtgaagctcatgtccgggaaggacgtgttctacctgccgcccgagaagtgcgacacgctgctgtgcgacatcggcgagagctcccccagcccgaccgtcgaggagtcccggaccatccgcgtgctcaagatggtggagccctggctgcggaacaaccagttctgcatcaaggtcctgaacccctacatgcccaccgtgatcgagcacctcgagcgcctgcagcggaagtacggcgggatgctggtgcgcaacccgctcagccggaactccacgcacgagatgtactggatcagcaacggcaccgggaacatcgtctccagcgtgaacatggtctcccgcctgctgctcaaccggttcaccatgacccaccgccggcccacgatcgagaaggacgtggacctgggcgcgggcacccgccacgtgaacgccgagcccgagaccccgaacatggacgtcatcggggagcggatcaagcgcatcaaggaggagcacagctccacctggcactacgacgacgagaacccctacaagacgtgggcctaccacggcagctacgaggtgaaggccaccgggagcgcctccagcatgatcaacggcgtggtcaagctgctcaccaagccctgggacgtggtgcccatggtcacccagatggcgatgacggacaccaccccgttcgggcagcagcgggtgttcaaggagaaggtggacacccgcacgccccggcccatgcccggcacccgcaaggtcatggagatcaccgccgagtggctgtggcggaccctgggccgcaacaagaagccgcgcctctgcacgcgggaggagttcaccaagaaggtgcgcaccaacgccgccatgggggccgtgttcaccgaggagaaccagtgggactccgcgcgggccgccgtcgaggacgaggagttctggaagctggtggacaaggagcgcgagctgcacaagctcggcaagtgcgggagctgcgtgtacaacatgatgggcaagcgggagaagaagctgggggagttcggcaaggccaagggctcccgcgcgatctggtacatgtggctgggggcccggtacctcgagttcgaggccctgggcttcctgaacgaggaccactggttcagccgcgagaactcctacagcggggtcgagggcgaggggctccacaagctgggctacatcctgcgggacatctccaagatccccggcggggccatgtacgccgacgacacggcgggctgggacacccgcatcaccgaggacgacctccacaacgaggagaagatcacccagcagatggaccccgagcaccggcagctggccaacgccatcttcaagctgacgtaccagaacaaggtggtgaaggtccagcgccccaccccgaaggggaccgtgatggacatcatcagccggaaggaccagcgcggctccggccaggtggggacctacggcctcaacaccttcacgaacatggaggcccagctggtccggcagatggagggggagggcgtgctgagcaaggccgacctcgagaacccccacctcctggagaagaagatcatccagtggctcgagaccaagggggtggagcgcctgaagcggatggcgatctccggcgacgactgcgtcgtgaagcccatcgacgaccgcttcgccaacgccctgctcgccctgaacgacatgggcaaggtgcggaaggacatcccccagtggcagccgagcaaggggtggcacgactggcagcaggtccccttctgctcccaccacttccacgagctgatcatgaaggacggccgcaagctcgtggtgccctgccggccccaggacgagctgatcgggcgcgcccgcatcagccagggcgcggggtggtccctgaaggagaccgcctgcctcggcaaggcctacgcccagatgtggagcctgatgtacttccaccggcgcgacctgcggctcgcctccaacgcgatctgcagcgccgtcccggtgcactggatccccaccagccgcacgacctggtccatccacgcccaccaccagtggatgaccaccgaggacatgctgagcgtgtggaaccgggtctggatcgaggacaacccctggatggaggacaagacgcccgtgaccacctgggaggacgtgccgtacctgggcaagcgcgaggaccagtggtgcgggtccctcatcggcctgaccagccgggccacgtgggcgcagaacatcctgaccgccatccagcaggtccgctccctcatcggggacgaggagttcctggactacatgcccagcatgaagcggttccgcaaggaggaggagtccgagggcgccatctggtga

SEQ ID NO: 9941 - RNA, 9873 nt, synthetic construct
  misc_feature 1..9873: note = derived and/or modified CDS sequence (opt1) from DENV-3__GU131933__SS-prME
  source 1..9873: mol_type = other RNA
accagcctgtgcctcatgatgatgctgcccgccaccctggccttccacctcaccagccgggacggcgagccgcggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacagcatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgccagccgggcctggaacgtgtgggaggtcgaggactacgggttcggcgtgttcacgaccaacatctggctgaagctccgcgaggtgtacacccagtcctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtcgtgatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcacgttcgtcctcctgctgtccggccagatcacctggcgcgacatggcgcacaccctcatcatgatcggcagcaacgccagcgaccggatggggatgggcgtgacctacctggccctgatcgccacgttcaagatccagcccttcctcgccctggggttcttcctgcgcaagctcacctcccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtcagcctgacgtgctccaacaccatcttcaccctgaccgtggcctggcgcacggccaccctcatcctggccggggtcagcctgctcccgctgtgccagtccagctccatgcggaagaccgactggctgcccatgaccgtggccgcgatgggcgtgccgcccctgccgctgttcatcttcagcctgaaggacacgcccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcaccgggacctccgccgacctgaccgtcgagaaggccgccgacgtgacgtgggaggaggaggccgagcagaccggcgtgagccacaacctcatgatcaccgtcgacgacgacgggaccatgcgcatcaaggacgacgagaccgagaacatcctgacggtgctgctcaagaccgcgctgctgatcgtgtccggcatcttcccctacagcatccccgccaccctcctggtctggcacacctggcagaagcagacgcagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggcctccgtgaagaaggacctcatcagctacggcgggggctggcggctgagcgcgcagtggcagaagggggaggaggtgcaggtcatcgccgtggagcccggcaagaacccgaagaacttccagaccatgcccggcatcttccagaccacgatgggggagatcggcgccatcgccctggacttcaagcccgggacctccggcagcccgatcatcaaccgcgagggcaaggtggtcgggctgtacggcaacggggtggtgaccaagaacggcgggtacgtctccggcatcgcgcagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagtccgagcacacgggccgggagatcgtggacctcatgtgccacgccaccttcaccatgcgcctgctgagcccggtgcgggtccccaactacaacctcgtgatcatggacgaggcgcacttcaccgaccccgcctccatcgccgcccgcgggtacatcagcacgcgggtgggcatgggcgaggccgcggccatcttcatgaccgccacgccgcccgggaccgccgaggcgttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgccaacttcaaggcggaccgcgtcatcgacccccggcgctgcctgaagcccgtgatcctgaccgacggccccgagcgggtgatcctcgccgggccgatgcccgtcacggccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagaccttcgtcgagctcatgcggcgcggggacctgcccgtgtggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcccggacctactccgaccccctcgcgctgaaggagttcaaggacttcgccgccggccgcaagagcatcgccctggacctcgtgaccgagatcgggcgggtgcccagccacctggcccaccgcacgcggaacgcgctggacaacctcgtcatgctgcacacctccgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtgatcgccagctccggcatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcgggatcctgaccctggccgcgatcgtggccgccaacgagatgggcctcctggagacgaccaagcgggacctgggcatgtccaaggagcccggggtcgtgagccccacctcctacctcgacgtggacctgcaccccgccagcgcctggaccctgtacgcggtcgccacgaccgtgatcaccccgatgctccgccacaccatcgagaactccacggccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacccactacgccatcatcggcccgggcctgcaggccaaggccacgcgggaggcccagaagcgcaccgcggccgggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcggacgagctgggccctgtgcgaggccctgaccctcgcgaccggccccatcaccacgctgtgggagggctccccggggaagttctggaacaccaccatcgccgtgagcatggccaacatcttccgcggctcctacctggccggggcgggcctcgccttcagcatcatgaagtccgtcgggaccggccggcgcggcacggggtcccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtgagccgcggctccgccaagctccagtggttcgtcgagcggaacatggtgatccccgaggggcgcgtgatcgacctgggctgcgggcgcggcgggtggagctactactgcgcgggcctgaagaaggtcaccgaggtgcggggctacaccaagggcgggcccgggcacgaggagcccgtgccgatgtccacctacggctggaacatcgtcaagctcatgagcgggaaggacgtgttctacctgccgcccgagaagtgcgacacgctgctgtgcgacatcggcgagtccagcccctccccgaccgtggaggagagccgcaccatccgggtcctcaagatggtggagccctggctgcgcaacaaccagttctgcatcaaggtgctgaacccctacatgcccaccgtcatcgagcacctcgagcggctgcagcgcaagtacggcgggatgctggtgcggaacccgctctcccgcaacagcacgcacgagatgtactggatctccaacggcaccgggaacatcgtgagctccgtcaacatggtgagccggctgctgctcaaccgcttcaccatgacccaccggcgccccacgatcgagaaggacgtcgacctgggcgccggcacccggcacgtgaacgccgagcccgagaccccgaacatggacgtgatcggggagcgcatcaagcggatcaaggaggagcactccagcacctggcactacgacgacgagaacccctacaagacgtgggcctaccacggcagctacgaggtcaaggccaccgggtccgcgagctccatgatcaacggcgtggtgaagctgctcaccaagccctgggacgtcgtgcccatggtgacccagatggccatgacggacaccaccccgttcgggcagcagcgcgtcttcaaggagaaggtggacacccggacgccccgccccatggccggcacccggaaggtgatggagatcaccgccgagtggctgtggcgcaccctgggccgcaacaagaagccccggctctgcacgcgcgaggagttcaccaagaaggtccggaccaacgccgcgatgggggccgtgttcaccgaggagaaccagtgggacagcgcccgcgccgcggtggaggacgaggagttctggaagctggtcgaccgggagcgcgagctgcacaagctcggcaagtgcgggtcctgcgtgtacaacatgatgggcaagcgggagaagaagctgggggagttcggcaaggccaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatcccgggcggggcgatgtacgccgacgacacggccggctgggacacccgcatcaccgaggacgacctccacaacgaggagaagatcacccagcagatggaccccgagcaccggcagctggccaacgccatcttcaagctgacgtaccagaacaaggtcgtgaaggtgcagcgccccacccccaaggggaccgtcatggacatcatctcccggaaggaccagcgcggcagcggccaggtggggacctacggcctcaacaccttcacgaacatggaggcgcagctggtgcggcagatggagggggagggcgtcctgtccaaggccgacctcgagaacccgcacctcctggagaagaagatcacccagtggctcgagaccaagggggtggagcgcctgaagcggatggccatcagcggcgacgactgcgtggtcaagcccatcgacgaccgcttcgccaacgccctgctcgcgctgaacgacatgggcaaggtgcggaaggacatcccccagtggcagccctccaaggggtggcacgactggcagcaggtcccgttctgcagccaccacttccacgagctgatcatgaaggacggccgcaagctcgtcgtgccctgccgcccccaggacgagctgatcgggcgggcccgcatctcccagggcgccgggtggagcctgaaggagaccgcctgcctcggcaaggcctacgcgcagatgtggtccctgatgtacttccaccggcgcgacctgcggctcgccagcaacgccatctgcagcgccgtgcccgtccactggatcccgacgtcccgcaccacctggagcatccacgcgcaccaccagtggatgaccacggaggacatgctgaccgtgtggaaccgggtgtggatcgaggacaacccctggatggaggacaagacccccgtcaccacgtgggaggacgtgccctacctgggcaagcgcgaggaccagtggtgcgggtccctcatcggcctgaccagccgggccacctgggcccagaacatcctgaccgccatccagcaggtccgctccctcatcggggacgaggagttcctggactacatgccgagcatgaagcggttccgcaaggaggaggagtccgagggcgccatctggtga

SEQ ID NO: 9942 - RNA, 9873 nt, synthetic construct
  misc_feature 1..9873: note = derived and/or modified CDS sequence (opt1) from DENV-3__GU131934__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctggatcgacgtggtgctcgagcacggcgggtgcgtcaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtggaccgggggtggggcaacgggtgcggcctgttcgggaagggcagcctggtgacctgcgccaagttccagtgcctcgagcccatcgagggcaaggtggtgcagtacgagaacctgaagtacacggtcatcatcaccgtgcacaccggggaccagcaccaggtgggcaacgacacccagggggtcacggtggagatcacgccccaggcctccaccgtcgaggccgtgctgcccgagtacggcaccctcgggctggagtgcagcccgcgcaccggcctggacttcaacgagatgatcctcctgacgatgaagaacaaggcgtggatggtgcaccggcagtggttcttcgacctgcccctcccctggacctccggcgccaccaccgagacgcccacctggaaccgcaaggagctgctggtcaccttcaagaacgcccacgccaagaagcaggaggtggtggtcctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtgagcgagacgcagcacgggaccatcctgatcaaggtcgagtacaagggcgaggacgccccgtgcaagatccccttcagcaccgaggacgggcagggcaaggcgcacaacggccgcctgatcaccgccaaccccgtggtgacgaagaaggaggagcccgtcaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtgggcggggtcctgaactccctcggcaagatggtgcaccagatcttcgggagcgcgtacaccgccctgttctccggcgtgagctggatcatgaagatcggcatcggggtcctgctcacgtggatcggcctgaactccaagaacaccagcatgtccttcagctgcatcgtgatcggggtgatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggcgaagatcgtgaccgccgagaaccagaacagctccttcatcatcgacggccccaacacccccgagtgccccagcgcctcccgggcctggaacgtgtgggaggtcgaggactacgggttcggcgtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacaccctctggtccaacggcgtgctggagagcgacatgatcatccccaagtccctggcggggcccatcagccagcacaaccaccggccgggctaccacacgcagaccgccgggccctggcacctcggcaagctggagctggacttcaactactgcgagggcaccaccgtcgtgatcgccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcaccttcgtcctcctgctgtccggccagatcacctggcgcgacatggcccacacgctcatcatgatcggcagcaacgcctccgaccggatggggatgggcgtgacctacctggccctgatcgccaccttcaagatccagcccttcctcgcgctggggttcttcctgcgcaagctcaccagccgggagaacctgctgctcggcgtgggcctggccatggccacgaccctgcagctccccgaggacatcgagcagatggccaacgggatcgcgctgggcctgatgaccctcaagctgatcacccagttcgagacgtaccagctgtggaccgccctcgtcagcctgacctgctccaacaccatcttcacgctgaccgtggcctggcgcaccgccaccctcatcctggccggggtcagcctgctcccgctgtgccagtccagctccatgcggaagacggactggctgcccatgaccgtggcggccatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccggcgggctcctgatcgcctgctacgtgatcaccgggacgtccgccgacctgaccgtcgagaaggccgccgacgtgacctgggaggaggaggcggagcagaccggggtgagccacaacctcatgatcacggtcgacgacgacgggaccatgcgcatcaaggacgacgagaccgagaacatcctgaccgtgctgctcaagaccgccctgctgatcgtgtccggcatcttcccctacagcatccccgccacgctcctggtctggcacacctggcagaagcagacccagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacccacaacgggaagcgcctggagcccaactgggcgtccgtgaagaaggacctcatcagctacggcgggggctggcggctgtccgcccagtggcagaagggggaggaggtgcaggtcatcgccgtggagcccggcaagaacccgaagaacttccagacgatccccggcatcttccagaccaccaccggggagatcggcgccatcgcgctggacttcaagcccgggacgagcggcagcccgatcatcaaccgcgagggcaaggtggtcgggctgtacggcaacggggtggtgaccaagaacggcgggtacgtctccggcatcgcccagaccaacgccgagcccgacggccccacccccgagctcgaggaggagatgttcaagaagcggaacctgacgatcatggacctgcacccggggagcggcaagacccgcaagtacctccccgccatcgtgcgggaggccatcaagcgccggctgcgcaccctgatcctcgcgcccacccgggtggtcgccgccgagatggaggaggccctgaaggggctgcccatccgctaccagacgaccgccaccaagtccgagcacaccggccgggagatcgtggacctcatgtgccacgcgacgttcaccatgcgcctgctgagcccggtgcgggtccccaactacaacctcgtgatcatggacgaggcccacttcaccgaccccgcctccatcgccgcccgcgggtacatcagcacccgggtgggcatgggcgaggcggccgccatcttcatgacggccacgccgcccgggaccgcggaggccttcccccagtccaacgcccccatccaggacgaggagcgcgacatccccgagcgcagctggaactccggcaacgagtggatcaccgacttcgtcgggaagacggtgtggttcgtgcccagcatcaaggccggcaacgacatcgccaactgcctgcggaagaacgggaagaaggtcatccagctgtcccgcaagaccttcgacaccgagtaccagaagacccggctcaacgactgggacttcgtggtgacgaccgacatcagcgagatgggcgcgaacttcaaggccgaccgcgtcatcgacccccggcgctgcctgaagcccgtgatcctgaccgacggccccgagcgggtgatcctcgccgggccgatgcccgtcaccgccgcctccgcggcccagcgccggggccgcgtggggcggaacccccagaaggagaacgaccagtacatcttcacgggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggacgaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgcaccgcacccggaacgccctggacaacctcgtcatgctgcacacgagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacgtccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagaccacgaagcgggacctgggcatgtccaaggagcccggggtggtgagccccacctcctacctcgacgtcgacctgcaccccgccagcgcctggaccctgtacgcggtggccaccacggtgatcaccccgatgctccgccacaccatcgagaactccaccgccaacgtcagcctggccgcgatcgccaaccaggccgtggtgctgatgggcctcgacaaggggtggcccatctccaagatggacctgggcgtccccctgctcgccctggggtgctacagccaggtgaaccccctgacgctcaccgccgcggtgctgctgctcgtcacccactacgccatcatcggcccgggcctgcaggccaaggccacccgggaggcccagaagcgcacggcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggaccagctgggccctgtgcgaggccctgacgctcgcgaccggccccatcaccaccctgtgggagggctccccggggaagttctggaacacgaccatcgccgtcagcatggccaacatcttccgcggctcctacctggccggggcgggcctcgccttcagcatcatgaagtccgtggggaccggccggcgcggcaccgggagccagggcgagacgctgggggagaagtggaagaagaagctgaaccagctcagccggaaggagttcgacctgtacaagaagtccggcatcaccgaggtggaccgcaccgaggccaaggaggggctgaagcggggcgagaccacccaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgacggaggtgcggggctacaccaagggcggccccgggcacgaggagcccgtcccgatgtccacctacggctggaacatcgtgaagctcatgagcgggaaggacgtgttctacctgccgcccgagaagtgcgacaccctgctgtgcgacatcggcgagtccagcccctccccgacggtcgaggagagccgcaccatccgggtgctcaagatggtggagccctggctgcgcaacaaccagttctgcatcaaggtcctgaacccctacatgcccaccgtgatcgagcacctcgagcggctgcagcgcaagtacggcgggatgctggtgcggaacccgctctcccgcaacagcacccacgagatgtactggatctccaacggcacggggaacatcgtcagctccgtgaacatggtcagccggctgctgctcaaccgcttcaccatgacccaccggcgccccaccatcgagaaggacgtggacctgggcgccggcacgcggcacgtgaacgccgagcccgagaccccgaacatggacgtcatcggggagcgcatcaagcggatcaaggaggagcactccagcacctggcactacgacgacgagaacccctacaagacctgggcctaccacggctcctacgaggtgaaggccacggggagcgcgagctccatgatcaacggcgtggtcaagctgctcaccaagccctgggacgtggtgcccatggtcacccagatggccatgaccgacacgaccccgttcgggcagcagcgcgtgttcaaggagaaggtggacacccggacgccccgccccatgcccggcacgcggaaggtcatggagatcaccgccgagtggctgtggcgcaccctgggccgcaacaagaagccgcggctctgcacccgcgaggagttcacgaagaaggtgcggaccaacgccgccatgggggcggtgttcaccgaggagaaccagtgggacagcgcccgcgccgccgtcgaggacgaggagttctggaagctggtggacaaggagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgcggacgacaccgccggctgggacacgcggatcaccgaggacgacctccacaacgaggagaagatcacccagcagatggaccccgagcaccgccagctggccaacgccatcttcaagctgacctaccagaacaaggtggtgaaggtccagcggcccacgccgaaggggaccgtgatggacatcatctcccgcaaggaccagcggggcagcggccaggtggggacctacggcctcaacaccttcaccaacatggaggcccagctggtccgccagatggagggggagggcgtgctgtccaaggcggacctcgagaacccccacctcctggagaagaagatcacgcagtggctcgagaccaagggggtggagcggctgaagcgcatggccatcagcggcgacgactgcgtcgtgaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtggtgccctgccgcccccaggacgagctgatcgggcgcgcgcggatctcccagggcgccgggtggagcctgaaggagaccgcctgcctcggcaaggcctacgcccagatgtggtccctgatgtacttccaccgccgggacctgcgcctcgcgagcaacgccatctgctccgccgtcccggtgcactggatccccaccagccggacgacctggagcatccacgcccaccaccagtggatgaccaccgaggacatgctgacggtgtggaaccgcgtctggatcgaggacaacccctggatggaggacaagacccccgtgaccacctgggaggacgtgccgtacctgggcaagcgggaggaccagtggtgcgggtccctcatcggcctgacgagccgcgcgacctgggcccagaacatcctgaccgccatccagcaggtccggtccctcatcggggacgaggagttcctggactacatgcccagcatgaagcgcttccggaaggaggaggagaccgagggcgccatctggtga

SEQ ID NO: 9943 - RNA, 9873 nt, synthetic construct
  misc_feature 1..9873: note = derived and/or modified CDS sequence (opt1) from DENV-3__GU131935__SS-prME
  source 1..9873: mol_type = other RNA
accagcctgtgcctcatgatgatgctgcccgcgaccctggccttccacctcaccagccgcgacggcgagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgccatcaactggaagggcaaggagctgaagtgcggctccgggatcttcgtgaccaacgaggtccacacgtggaccgagcagtacaagttccaggcggacagccccaagcgcctggccaccgccatcgccggcgcctgggagaacggggtgtgcggcatccgctccaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggccaagatcgtcaccgccgagacccagaactccagcttcatcatcgacggccccaacacccccgagtgcccctccgccagccgggcgtggaacgtgtgggaggtggaggactacgggttcggcgtcttcacgaccaacatctggctgaagctccgcgaggtgtacacccagagctgcgaccaccggctgatgtccgccgccatcaaggacgagcgcgccgtgcacgccgacatgggctactggatcgagagccagaagaacgggtcctggaagctggagaaggcgagcttcatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtgaagtccctggtcagcgccggctccgggaaggtggacaacttcaccatgggcgtgctgtgcctcgccatcctgttcgaggaggtcatgcgggggaagttcggcaagaagcacatgatcgcgggggtgctgttcacgttcgtgctcctgctgagcggccagatcacctggcgcgacatggcccacaccctcatcatgatcggctccaacgccagcgaccggatggggatgggcgtcacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgtccctgacgtgcagcaacaccatcttcaccctgaccgtcgcctggcgcacggccaccctcatcctggccggggtgtccctgctcccgctgtgccagagctccagcatgcggaagaccgactggctgcccatgaccgtcgcggccatgggcgtgccgcccctgccgctgttcatcttctccctgaaggacacgcccaagcgccgcagctggcccctcaacgagggggtgatggccgtcggcctggtgtccatcctggccagctccctcctgcggaacgacgtgcccatggccggcccgctggtcgccggcgggctcctgatcgcctgctacgtgatcaccgggaccagcgccgacctgaccgtggagaaggccgccgacgtcacgtgggaggaggaggcggagcagaccggggtgtcccacaacctcatgatcaccgtggacgacgacgggaccatgcgcatcaaggacgacgagaccgagaacatcctgacggtcctgctcaagaccgccctgctgatcgtgagcggcatcttcccctactccatccccgccaccctcctggtgtggcacacctggcagaagcagacgcagcggagcggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagcccaactgggcgagcgtcaagaaggacctcatctcctacggcgggggctggcggctgaacgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagacgaacgccgagcccgacggccccacccccgagctcgaggaggagatgttcaagaagcggaacctgaccatcatggacctgcacccggggagcggcaagacccgcaagtacctccccgccatcgtccgggaggccatcaagcgccggctgcgcacgctgatcctcgcgcccacccgggtggtggccgccgagatggaggaggccctgaaggggctgcccatccgctaccagaccaccgccacgaagtccgagcacaccggccgggagatcgtcgacctcatgtgccacgcgaccttcaccatgcgcctgctgagcccggtgcgggtgcccaactacaacctcgtcatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcgcagctggaactccggcaacgagtggatcaccgacttcgtggggaagaccgtctggttcgtgcccagcatcaaggccggcaacgacatcgccaactgcctgcggaagaacgggaagaaggtgatccagctgtcccgcaagaccttcgacacggagtaccagaagacccggctcaacgactgggacttcgtcgtgaccaccgacatcagcgagatgggcgcgaacttcaaggccgaccgcgtgatcgacccccggcgctgcctgaagcccgtcatcctgacggacggccccgagcgggtgatcctcgccgggccgatgcccgtgaccgccgcctccgcggcccagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtggagctcatgcggcgcggggacctgcccgtctggctggcccacaaggtggccagcgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtcacggagatcgggcgggtgccctcccacctggcgcaccgcacccggaacgccctggacaacctcgtgatgctgcacaccagcgagcacggcgggcgcgcctaccggcacgccgtcgaggagctgccggagaccatggagacgctcctgctgctcggcctgatgatcctgctcaccgggggcgtgatgctgttcctgatcagcggcaaggggatcggcaagacctccatcgggctcatctgcgtgatcgtcagctccggcatgctgtggatggccgacgtgcccctgcagtggatcgcgagcgccatcgtgctcgagttcttcatgatggtcctgctgatccccgagcccgagaagcagcgcaccccgcaggacaaccagctcgcctacgtggtgatcgggatcctgacgctggccgccatcgtcgcggccaacgagatgggcctcctggagaccaccaagcgggacctgggcatgtccaaggagcccggggtggtgagccccacctcctacctcgacgtcgacctgcaccccgccagcgcctggacgctgtacgccgtggcgaccaccgtgatcaccccgatgctccgccacacgatcgagaactccaccgccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacgcactacgcgatcatcggcccgggcctgcaggccaaggccacccgggaggcccagaagcgcaccgccgcggggatcatgaagaaccccaccgtggacggcatcatgacgatcgacctggaccccgtgatctacgactccaagttcgagaagcagctcgggcaggtcatgctgctggtgctctgcaccgtgcagctgctgctcatgcggaccagctgggccctgtgcgaggccctgaccctcgccacgggccccatcaccaccctgtgggagggctccccggggaagttctggaacaccacgatcgccgtcagcatggcgaacatcttccgcggctcctacctggccggggccggcctcgccttcagcatcatgaagtccgtggggaccggccggcgcggcaccgggagccagggcgagaccctgggggagaagtggaagaagaagctgaaccagctcagccggaaggagttcgacctgtacaagaagtccggcatcaccgaggtggaccgcacggaggcgaaggaggggctgaagcggggcgagaccacccaccacgccgtcagccgcggctccgccaagctccagtggttcgtggagcggaacatggtgatccccgaggggcgcgtcatcgacctgggctgcgggcgcggcgggtggagctactactgcgccggcctgaagaaggtgaccgaggtgcggggctacacgaagggcggccccgggcacgaggagcccgtcccgatgtccacctacggctggaacatcgtgaagctcatgagcgggaaggacgtgttctacctgccgcccgagaagtgcgacaccctgctgtgcgacatcggcgagtccagcccctccccgaccgtcgaggagagccgcacgatccgggtgctcaagatggtggagccctggctgcgcaacaaccagttctgcatcaaggtcctgaacccctacatgcccaccgtgatcgagcacctcgagcggctgcagcgcaagtacggcgggatgctggtgcggaacccgctctcccgcaacagcacccacgagatgtactggatctccaacggcaccgggaacatcgtcagctccgtgaacatggtcagccggctgctgctcaaccgcttcacgatgacccaccggcgccccaccatcgagaaggacgtggacctgggcgccggcacccggcacgtgaacgcggagcccgagacgccgaacatggacgtcatcggggagcgcatcaagcggatcaaggaggagcactccagcacctggcactacgacgacgagaacccctacaagacctgggcctaccacggctcctacgaggtgaaggccaccgggagcgccagctccatgatcaacggcgtggtcaagctgctcacgaagccctgggacgtggtgcccatggtcacccagatggccatgaccgacaccacgccgttcgggcagcagcgcgtgttcaaggagaaggtggacacccggacgccccggcccatgcccggcacccggaaggtcatggagatcacggcggagtggctgtggcgcaccctgggccgcaacaagaagccgcggctctgcacccgcgaggagttcaccaagaaggtgcggacgaacgccgccatgggggccgtgttcaccgaggagaaccagtgggacagcgcccgcgcggccgtcgaggacgaggagttctggaagctggtggaccgggagcgcgagctgcacaagctcggcaagtgcgggtcctgcgtgtacaacatgatgggcaagcgggagaagaagctgggggagttcggcaaggccaagggcagccgcgccatctggtacatgtggctgggggcgcggtacctcgagttcgaggccctgggcttcctgaacgaggaccactggttctcccgcgagaacagctactccggggtcgagggcgaggggctccacaagctgggctacatcctgcgggacatcagcaagatccccggcggggccatgtacgccgacgacaccgccggctgggacacccgcatcacggaggacgacctccacaacgaggagaagatcacccagcagatggaccccgagcaccggcagctggcgaacgccatcttcaagctgacctaccagaacaaggtggtgaaggtccagcgccccaccccgaaggggaccgtgatggacatcatctcccggaaggaccagcgcggcagcggccaggtggggacgtacggcctcaacaccttcaccaacatggaggcccagctggtccggcagatggagggggagggcgtgctgtccaaggccgacctcgagaacccccacctcctggagaagaagatcacccagtggctcgagacgaagggggtggagcgcctgaagcggatggccatcagcggcgacgactgcgtcgtgaagcccatcgacgaccgcttcgcgaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtggtgccctgccgcccccaggacgagctgatcgggcgggcccgcatctcccagggcgccgggtggagcctgaaggagaccgcgtgcctcggcaaggcctacgcccagatgtggtccctgatgtacttccaccggcgcgacctgcggctcgccagcaacgccatctgctccgcggtcccggtgcactggatccccaccagccgcaccacgtggagcatccacgcccaccaccagtggatgaccaccgaggacatgctgaccgtgtggaaccgggtctggatcgaggacaacccctggatggaggacaagacgcccgtgaccacctgggaggacgtgccgtacctgggcaagcgcgaggaccagtggtgcgggtccctcatcggcctgaccagccgggccacgtgggcccagaacatcctgaccgcgatccagcaggtccgctccctcatcgggaacgaggagttcctggactacatgcccagcatgaagcggttccgcaaggaggaggagtccgagggcgccatctggtga

SEQ ID NO: 9944 - RNA, 9873 nt, synthetic construct
  misc_feature 1..9873: note = derived and/or modified CDS sequence (opt1) from DENV-3__GU131936__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagtccatcgagggcaaggtggtccagtacgagaacctgaagtacacggtgatcatcaccgtgcacaccggggaccagcaccaggtcggcaacgacacccagggggtgacggtcgagatcacgccccaggccagcaccgtggaggccgtgctgcccgagtacggcaccctcgggctggagtgcagcccccggaccggcctggacttcaacgagatgatcctcctgacgatgaagaacaaggcgtggatggtccaccggcagtggttcttcgacctgccgctcccctggaccagcggcgccaccaccgagacgcccacctggaaccgcaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtcagcgagacgcagcacgggaccatcctgatcaaggtggagtacaagggcgaggacgccccctgcaagatcccgttctccaccgaggacgggcagggcaaggcgcacaacggccgcctgatcaccgccaaccccgtggtcacgaagaaggaggagcccgtgaacatcgaggccgagcccccgttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcgcgctcacgccccagcccatggagctgaagtacagctggaagacctgggggaaggccaagatcgtgacggccgagacccagaactccagcttcatcatcgacggcccgaacacccccgagtgcccctccgccagccgggcgtggaacgtgtgggaggtcgaggactacgggttcggcgtgttcaccacgaacatctggctgaagctccgcgaggtgtacacccagagctgcgaccaccggctgatgtccgccgccatcaaggacgagcgcgccgtccacgccgacatgggctactggatcgagagccagaagaacgggtcctggaagctggagaaggcgagcttcatcgaggtgaagacctgcacctggcccaagtcccacaccctctggagcaacggcgtgctggagtccgacatgatcatccccaagtccctggccgggcccatctcccagcacaaccaccggcccggctaccacacgcagaccgccgggccgtggcacctcggcaagctggagctggacttcaactactgcgagggcaccaccgtcgtgatcgccgagaactgcgggacgcgcggccccagcctccggaccaccaccgtgtccgggaagctgatccacgagtggtgctgccgcagctgcacgctgccgcccctgcggtacatgggcgaggacgggtgctggtacggcatggagatccgcccgatcaacgagaaggaggagaacatggtcaagtccctggtgagcgccggctccgggaaggtggacaacttcaccatgggcgtcctgtgcctcgcgatcctgttcgaggaggtgatgcgggggaagttcggcaagaagcacatgatcgccggggtgctgttcaccttcgtcctcctgctgagcggccagatcacctggcgcgacatggcccacacgctcatcatgatcggctccaacgccagcgaccggatggggatgggcgtgacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatgaccctcaagctgatcacccagttcgagacgtaccagctgtggaccgccctcgtctccctgacctgcagcaacaccatcttcacgctgaccgtggcctggcgcaccgccaccctcatcctggcgggggtctccctgctccccctgtgccagagctccagcatgcggaagacggactggctgccgatgaccgtggccgccatgggcgtgccgcccctccccctgttcatcttctccctgaaggacaccccgaagcgccgcagctggcccctcaacgagggggtcatggccgtgggcctggtgtccatcctggccagctccctcctgcggaacgacgtccccatggcgggccccctggtggccgggggcctcctgatcgcctgctacgtgatcaccgggacgagcgccgacctgaccgtcgagaaggccgcggacgtgacctgggaggaggaggccgagcagaccggcgtgtcccacaacctcatgatcacggtcgacgacgacgggaccatgaagatcaaggacgacgagaccgagaacatcctgaccgtgctgctcaagaccgccctgctgatcgtgagcggcatcttcccgtactccatccccgccacgctcctggtctggcacacctggcagaagcagacccagcgcagcggcgtgctgtgggacgtgcccagcccgcccgagacccagaaggccgagctcgaggagggggtctaccggatcaagcagcagggcatcttcgggaagacccaggtgggcgtgggggtccagaaggagggcgtgttccacaccatgtggcacgtgacccgcggcgcggtcctgacccacaacgggaagcggctggagcccaactgggccagcgtgaagaaggacctcatctcctacggcgggggctggcgcctgagcgcccagtggcagaagggggaggaggtgcaggtcatcgccgtggagcccggcaagaaccccaagaacttccagacgatgcccggcatcttccagaccaccaccggggagatcggcgcgatcgccctggacttcaagcccgggacgagcggctcccccatcatcaaccgggagggcaaggtggtcgggctgtacggcaacggggtggtgaccaagaacggcgggtacgtcagcggcatcgcccagaccaacgccgagccggacggccccacccccgagctcgaggaggagatgttcaagaagcgcaacctgacgatcatggacctgcaccccgggtccggcaagacccggaagtacctcccggccatcgtgcgcgaggcgatcaagcggcgcctgcggaccctgatcctcgcccccacccgcgtggtcgccgccgagatggaggaggccctgaaggggctgcccatccggtaccagacgaccgcgaccaagagcgagcacaccggccgcgagatcgtggacctcatgtgccacgccacgttcaccatgcggctgctgtcccccgtgcgcgtcccgaactacaacctcgtgatcatggacgaggcccacttcaccgaccccgccagcatcgccgcgcgggggtacatctccacccgcgtgggcatgggcgaggccgccgccatcttcatgacggcgacgccgcccgggaccgccgaggccttcccgcagagcaacgcccccatccaggacgaggagcgggacatccccgagcgctcctggaacagcggcaacgagtggatcaccgacttcgtcgggaagacggtgtggttcgtgccctccatcaaggccggcaacgacatcgcgaactgcctgcgcaagaacgggaagaaggtcatccagctgagccggaagaccttcgacaccgagtaccagaagacccgcctcaacgactgggacttcgtggtgacgaccgacatctccgagatgggcgccaacttcaaggccgaccgggtcatcgacccgcgccggtgcctgaagcccgtgatcctgaccgacggccccgagcgcgtgatcctcgccgggcccatgccggtcaccgccgcgagcgccgcccagcggcgcggccgggtggggcgcaacccccagaaggagaacgaccagtacatcttcatgggccagcccctgaacaacgacgaggaccacgcccactggacggaggccaagatgctgctcgacaacatcaacacccccgaggggatcatcccggcgctgttcgagcccgagcgggagaagtccgccgccatcgacggcgagtaccgcctgaagggcgagagccggaagaccttcgtcgagctcatgcgccgcggggacctgcccgtgtggctggcccacaaggtggcgtccgagggcatcaagtacaccgaccgcaagtggtgcttcgacggggagcggaacaaccagatcctcgaggagaacatggacgtcgagatctggaccaaggagggcgagcgcaagaagctgcggccccgctggctggacgcccgcacgtacagcgacccgctcgccctgaaggagttcaaggacttcgccgccggccggaagtccatcgcgctggacctcgtgaccgagatcgggcgcgtgcccagccacctggcccaccggacccgcaacgccctggacaacctcgtcatgctgcacaccagcgagcacggcgggcgggcctaccgccacgccgtggaggagctgcccgagacgatggagaccctcctgctgctcggcctgatgatcctgctcaccgggggcgcgatgctgttcctgatctccggcaaggggatcggcaagaccagcatcgggctcatctgcgtgatcgtctccagcggcatgctgtggatggccgacgtgccgctgcagtggatcgcctccgccatcgtgctcgagttcttcatgatggtcctgctgatccccgagcccgagaagcagcggacgccccaggacaaccagctcgcctacgtggtgatcgggatcctgaccctggcggccatcgtcgccgccaacgagatgggcctcctggagaccaccaagcgcgacctgggcatgagcaaggagccgggggtggtgtcccccacgagctacctcgacgtcgacctgcaccccgcctccgcgtggaccctgtacgccgtggccaccaccgtgatcacgcccatgctccggcacaccatcgagaacagcaccgccaacgtctccctggcggccatcgccaaccaggccgtggtgctgatgggcctcgacaaggggtggccgatcagcaagatggacctgggcgtccccctgctcgccctggggtgctactcccaggtgaaccccctgaccctcacggcggccgtgctgctgctcgtcacccactacgccatcatcggccccggcctgcaggccaaggccacccgcgaggcgcagaagcggaccgccgccgggatcatgaagaacccgacggtggacggcatcatgaccatcgacctggaccccgtgatctacgacagcaagttcgagaagcagctcgggcaggtcatgctgctggtgctctgcgccgtgcagctgctgctcatgcgcacctcctgggccctgtgcgaggcgctgaccctcgccacgggccccatcaccaccctgtgggagggcagccccgggaagttctggaacaccacgatcgccgtctccatggccaacatcttccggggcagctacctggcgggggccggcctcgccttctccatcatgaagtccgtggggaccggccgccggggcaccgggagccagggcgagaccctgggggagaagtggaagaagaagctgaaccagctctcccgcaaggagttcgacctgtacaagaagtccggcatcacggaggtggaccggaccgaggccaaggaggggctgaagcgcggcgagaccacccaccacgccgtctcccggggcagcgcgaagctccagtggttcgtggagcgcaacatggtgatcccggaggggcgggtcatcgacctgggctgcgggcgcggcgggtggtcctactactgcgccggcctgaagaaggtgaccgaggtgcgcggctacacgaagggcgggcccgggcacgaggagcccgtccccatgagcacctacggctggaacatcgtgaagctcatgtccgggaaggacgtgttctacctgccgcccgagaagtgcgacaccctgctgtgcgacatcggcgagagctcccccagccccaccgtcgaggagtcccggacgatccgcgtgctcaagatggtggagccgtggctgcggagcaaccagttctgcatcaaggtcctgaacccctacatgcccaccgtgatcgagcacctcgagcgcctgcagcggaagtacggcgggatgctggtgcgcaaccccctctcccggaacagcacccacgagatgtactggatctccaacggcaccgggaacatcgtcagctccgtgaacatggtcagccgcctgctgctcaaccggttcacgatgacccaccgccggccgaccatcgagaaggacgtggacctgggcgccggcacccgccacgtgaacgccgagcccgagacgcccaacatggacgtcatcggggagcggatcaagcgcatcaaggaggagcactccagcacctggcactacgacgacgagaacccgtacaagacctgggcctaccacggcagctacgaggtgaaggcgaccgggtccgccagctccatgatcaacggcgtggtcaagctgctcacgaagccctgggacgtggtgcccatggtcacccagatggccatgaccgacaccacgcccttcgggcagcagcgggtgttcaaggagaaggtggacacccgcaccccgcggcccatgcccggcacccgcaaggtcatggagatcacggccgagtggctgtggcggaccctgggccgcaacaagaagccccgcctctgcacccgggaggagttcaccaagaaggtgcgcacgaacgccgcgatgggggccgtgttcaccgaggagaaccagtgggacagcgcccgggccgcggtcgaggacgaggagttctggaagctggtggacaaggagcgcgagctgcacaagctcggcaagtgcgggtcctgcgtgtacaacatgatgggcaagcgggagaagaagctgggggagttcggcaaggccaagggcagccgcgccatctggtacatgtggctgggggcccggtacctcgagttcgaggccctgggcttcctgaacgaggaccactggttctcccgcgagaacagctactccggggtcgagggcgaggggctccacaagctgggctacatcctgcgggacatcagcaagatcccgggcggggcgatgtacgccgacgacaccgccggctgggacacccgcatcacggaggacgacctccacaacgaggagaagatcacccagcagatggaccccgagcaccggcagctggccaacgccatcttcaagctgacctaccagaacaaggtggtgaaggtccagcgccccacccccaaggggacggtgatggacatcatctcccggaaggaccagcgcggcagcggccaggtggggacctacggcctcaacaccttcaccaacatggaggcgcagctggtccggcagatggagggggagggcgtgctgtccaaggccgacctcgagaacccgcacctcctggagaagaagatcacccagtggctcgagacgaagggggtggagcgcctgaagcggatggccatcagcggcgacgactgcgtcgtgaagcccatcgacgaccgcttcgccaacgccctgctcgcgctgaacgacatgggcaaggtgcggaaggacatcccccagtggcagccctccaaggggtggcacgactggcagcaggtcccgttctgcagccaccacttccacgagctgatcatgaaggacggccgcaagctcgtggtgccctgccggccccaggacgagctgatcgggcgcgcccgcatctcccagggcgccgggtggagcctgaaggagaccgcctgcctcggcaaggcctacgcgcagatgtggtccctgatgtacttccaccggcgcgacctgcggctcgccagcaacgccatctgcagcgccgtccccgtgcactggatcccgacctcccgcaccacgtggagcatccacgcgcaccaccagtggatgaccaccgaggacatgctgaccgtgtggaaccgggtctggatcgaggacaacccctggatggaggacaagacgcccgtgaccacctgggaggacgtgccctacctgggcaagcgcgaggaccagtggtgcgggtccctcatcggcctgaccagccgggccacgtgggcccagaacatcctgaccgccatccagcaggtccgctccctcatcggggacgaggagttcctggactacatgccgagcatgaagcggttccgcaaggaggaggagaccgagggcgccatctggtga

SEQ ID NO: 9945 - RNA, 9873 nt, synthetic construct
  misc_feature 1..9873: note = derived and/or modified CDS sequence (opt1) from DENV-3__GU131937__SS-prME
  source 1..9873: mol_type = other RNA
accagcctgtgcctcatgatgatgctgcccgccaccctggccttccacctcaccagccgcgacggcgagccgcggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggagcgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggcgaagatcgtgaccgccgagacccagaactccagcttcatcatcgacggccccaacacccccgagtgcccctccacgctgcgggcctggaacgtgtgggaggtcgaggactacgggttcggcgtgttcaccaccaacatctggctcaagctgcgcgaggtgtacacccagagctgcgaccaccggctgatgagcgccgcgatcaaggacgagcgcgccgtccacgccgacatgggctactggatcgagtcccagaagaacgggagctggaagctcgagaaggcctccttcatcgaggtgaagacctgcacgtggcccaagagccacaccctgtggtccaacggcgtgctggagagcgacatgatcatccccaagtccctcgccgggcccatcagccagcacaactaccggccgggctaccacacccagaccgcggggccctggcacctgggcaagctggagctcgacttcaactactgcgagggcacgaccgtcgtgatcaccgagaactgcgggacccgcggcccctccctgcggacgaccaccgtgagcgggaagctgatccacgagtggtgctgccgctcctgcaccctgccgcccctgcggtacatgggcgaggacgggtgctggtacggcatggagatccgccccatcaacgagaaggaggagaacatggtcaagagcctggtgtccgccggcagcgggaaggtggacaacttcacgatgggcgtcctctgcctggccatcctgttcgaggaggtgatgcgggggaagttcggcaagaagcacatgatcgccggggtcctgttcaccttcgtcctgctgctctccggccagatcacctggcgcgacatggcccacaccctgatcatgatcggcagcaacgcgtccgaccggatggggatgggcgtgacgtacctggccctcatcgccaccttcaagatccagcccttcctggccctggggttcttcctccgcaagctgaccagccgggagaacctgctcctgggcgtgggcctggccatggcgaccacgctccagctgcccgaggacatcgagcagatggccaacgggatcgccctgggcctcatgaccctgaagctgatcacccagttcgagacctaccagctctggacggccctggtcagcctgacctgctccaacaccatcttcaccctcacggtggcgtggcgcaccgccaccctgatcctggccggggtcagcctcctgcccctgtgccagtccagctccatgcggaagaccgactggctccccatgacggtggccgccatgggcgtgccgcccctcccgctgttcatcttcagcctcaaggacacccccaagcgccgctcctggcccctgaacgagggggtcatggcggtgggcctggtgagcatcctcgcctccagcctgctgcggaacgacgtccccatggccggcccgctcgtggccgggggcctgctgatcgcctgctacgtgatcaccgggacctccgcggacctcacggtcgagaaggccgccgacgtgacctgggaggaggaggccgagcagaccggcgtgagccacaacctgatgatcaccgtcgacgacgacgggaccatgcgcatcaaggacgacgagacggagaacatcctgaccgtgctcctgaagaccgccctgctcatcgtgtccggcatcttcccctacagcatccccgcgaccctgctggtctggcacacgtggcagaagcagacccagcggtccggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgccgtcctgacccacaacgggaagcgcctcgagcccaactgggcctccgtgaagaaggacctgatcagctacggcgggggctggcggctgtccgcccagtggcagaagggggaggaggtgcaggtcatcgcggtggagcccggcaagaacccgaagaacttccagaccatgcccggcatcttccagacgaccaccggggagatcggcgccatcgccctggacttcaagcccgggaccagcggcagcccgatcatcaaccgcgagggcaaggtggtcgggctctacggcaacggggtggtgacgaagaacggcgggtacgtctccggcatcgcccagaccaacgcggagcccgacggccccacccccgagctggaggaggagatgttcaagaagcggaacctgaccatcatggacctccacccggggagcggcaagacgcgcaagtacctgcccgccatcgtgcgggaggccatcaagcgccggctgcgcaccctcatcctggcccccacccgggtggtcgccgcggagatggaggaggccctgaaggggctccccatccgctaccagaccacggccaccaagtccgagcacaccggccgggagatcgtggacctgatgtgccacgccaccttcacgatgcgcctgctcagcccggtgcgggtccccaactacaacctggtgatcatggacgaggcccacttcaccgaccccgcgtccatcgccgcccgcgggtacatcagcacccgggtgggcatgggcgaggccgccgcgatcttcatgaccgccacgcccccggggaccgccgaggccttcccccagtccaacgcgcccatccaggacgaggagcgcgacatccccgagcgcagctggaactccggcaacgagtggatcaccgacttcgtcgggaagaccgtgtggttcgtgccgagcatcaaggccggcaacgacatcgccaactgcctgcggaagaacgggaagaaggtcatccagctctcccgcaagacgttcgacaccgagtaccagaagacccggctgaacgactgggacttcgtggtgaccacggacatcagcgagatgggcgccaacttcaaggccgaccgcgtcatcgacccccggcgctgcctgaagcccgtgatcctcaccgacggccccgagcgggtgatcctggcggggccgatgcccgtcaccgccgcctccgccgcccagcgccggggccgcgtggggcggaacccccagaaggagaacgaccagtacatcttcaccggccagcccctgaacaacgacgaggaccacgcgcactggaccgaggccaagatgctcctggacaacatcaacacgccggaggggatcatccccgccctgttcgagcccgagcgcgagaagtccgccgccatcgacggcgagtaccggctcaagggcgagtcccgcaagaccttcgtcgagctgatgcggcgcggggacctgcccgtgtggctcgcgcacaaggtggccagcgagggcatcaagtacaccgaccggaagtggtgcttcgacggggagcgcaacaaccagatcctggaggagaacatggacgtcgagatctggaccaaggagggcgagcggaagaagctgcgcccgcgctggctcgacgcccggacgtactccgaccccctggccctgaaggagttcaaggacttcgcggccggccgcaagagcatcgccctcgacctggtgaccgagatcgggcgggtgccctcccacctggcccaccgcacccggaacgccctcgacaacctggtcatgctgcacaccagcgagcacggcgggcgcgcgtaccggcacgccgtggaggagctcccggagacgatggagaccctgctgctcctgggcctgatgatcagcctcaccgggggcgccatgctgttcctgatctccggcaaggggatcggcaagaccagcatcgggctcatctgcgtgatcgtctccagcggcatgctgtggatggccgacgtgcccctgcagtggatcgcctccgcgatcgtgctcgagttcttcatgatggtcctgctgatccccgagcccgagaagcagcgcacgccgcaggacaaccagctcgcctacgtggtgatcgggatcctgaccctggccgccatcgtcgccgcgaacgagatgggcctcctggagaccaccaagcgggacctgggcatgagcaaggagcccggggtggtgtcccccacgagctacctcgacgtcgacctgcaccccgcctccgcctggaccctgtacgccgtggccaccaccgtgatcacgccgatgctccgccacaccatcgagaacagcaccgcgaacgtctccctggccgccatcgccaaccaggcggtggtgctgatgggcctcgacaaggggtggcccatcagcaagatggacctgggcgtccccctgctcgccctggggtgctactcccaggtgaaccccctgaccctcacggccgccgtgctgctgctcgtcacccactacgccatcatcggcccgggcctgcaggcgaaggccacccgggaggcccagaagcgcaccgccgccgggatcatgaagaaccccacggtggacggcatcatgaccatcgacctggaccccgtgatctacgacagcaagttcgagaagcagctcgggcaggtcatgctgctggtgctctgcgcggtgcagctgctgctcatgcggacctcctgggccctgtgcgaggccctgaccctcgccacgggccccatcaccaccctgtgggagggcagcccggggaagttctggaacaccacgatcgccgtctccatggcgaacatcttccgcggcagctacctggccggggccggcctcgccttctccatcatgaagtccgtggggaccggccggcgcggcaccgggagccagggcgagaccctgggggagaagtggaagaagaagctgaaccagctctcccggaaggagttcgacctgtacaagaagtccggcatcaccgaggtggaccgcacggaggcgaaggaggggctgaagcggggcgagaccacccaccacgccgtctcccgcggcagcgccaagctccagtggttcgtggagcggaacatggtgatccccgaggggcgcgtcatcgacctgggctgcgggcgcggcgggtggtcctactactgcgccggcctgaagaaggtgaccgaggtgcggggctacacgaagggcgggcccgggcacgaggagcccgtcccgatgagcacctacggctggaacatcgtgaagctcatgtccgggaaggacgtgttctacctgccgcccgagaagtgcgacaccctgctgtgcgacatcggcgagagctcccccagcccgaccgtcgaggagaaccgcacgatccgggtgctcaagatggtggagccctggctgcgcaacaaccagttctgcatcaaggtcctgaacccctacatgcccaccgtgatcgagcacctcgagcggctgcagcgcaagtacggcgggatgctggtgcggaacccgctctcccgcaacagcacccacgagatgtactggatctccaacggcaccgggaacatcgtcagctccgtgaacatggtcagccggctgctgctcaaccgcttcacgatgacccaccggcgccccaccatcgagaaggacgtggacctgggcgccggcacccggcacgtgaacgcggagcccgagacgccgaacatggacgtcatcggggagcgcatcaagcggatcaaggaggagcactccagcacctggcactacgacgacgagaacccctacaagacctgggcctaccacggctcctacgaggtgaaggccaccgggagcgccagctccatgatcaacggcgtggtcaagctgctcacgaagccctgggacgtggtgcccatggtcacccagatggccatgaccgacaccacgccgttcgggcagcagcgcgtgttcaaggagaaggtggacacccggacgccccggcccatgcccggcacccggaaggtcatggagatcacggcggagtggctgtggcgcaccctgggccgcaacaagaagccgcggctctgcacccgcgaggagttcaccaagaaggtgcggacgaacgccgccatgggggccgtgttcaccgaggagaaccagtgggacagcgcccgcgcggccgtcgaggacgaggagttctggaagctggtggaccgggagcgcgagctgcacaagctcggcaagtgcgggtcctgcgtgtacaacatgatgggcaagcgggagaagaagctgggggagttcggcaaggccaagggcagccgcgccatctggtacatgtggctgggggcgcggtacctcgagttcgaggccctgggcttcctgaacgaggaccactggttctcccgcgagaacagctactccggggtcgagggcgaggggctccacaagctgggctacatcctgcgggacatcagcaagatccccggcggggccatgtacgccgacgacaccgccggctgggacacccgcatcacggaggacgacctccacaacgaggagaagatcacccagcagatggaccccgagcaccggcagctggcgaacgccatcttcaagctgacctaccagaacaaggtggtgaaggtccagcgccccaccccgaaggggaccgtgatggacatcatctcccggaaggaccagcgcggcagcggccaggtggggacgtacggcctcaacaccttcaccaacatggaggcccagctggtccggcagatggagggggagggcgtgctgtccaaggccgacctcgagaacccccacctcctggagaagaagatcacccagtggctcgagacgaagggggtggagcgcctgaagcggatggccatcagcggcgacgactgcgtcgtgaagcccatcgacgaccgcttcgcgaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtggtgccctgccgcccccaggacgagctgatcgggcgggcccgcatctcccagggcgccgggtggagcctgaaggagaccgcgtgcctcggcaaggcctacgcccagatgtggtccctgatgtacttccaccggcgcgacctgcggctcgccagcaacgccatctgctccgcggtcccggtgcactggatccccaccagccgcaccacgtggagcatccacgcccaccaccagtggatgaccaccgaggacatgctgaccgtgtggaaccgggtctggatcgaggacaacccctggatggaggacaagacgcccgtgaccacctgggaggacgtgccgtacctgggcaagcgcgaggaccagtggtgcgggtccctcatcggcctgaccagccgggccacgtgggcccagaacatcctgaccgcgatccagcaggtccgctccctcatcggggacgaggagttcctggactacatgcccagcatgaagcggttccgcaaggaggaggagtccgagggcgccatctggtga

SEQ ID NO: 9946 - RNA, 9873 nt, synthetic construct
  misc_feature 1..9873: note = derived and/or modified CDS sequence (opt1) from DENV-3__GU131938__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagtccatcgagggcaaggtggtccagtacgagaacctgaagtacacggtgatcatcaccgtgcacaccggggaccagcaccaggtcggcaacgacacccagggggtgacggtcgagatcacgccccaggccagcaccgtggaggccgtgctgcccgagtacggcaccctcgggctggagtgcagcccccggaccggcctggacttcaacgagatgatcctcctgacgatgaagaacaaggcgtggatggtccaccggcagtggttcttcgacctgccgctcccctggaccagcggcgccaccaccgagacgcccacctggaaccgcaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtcagcgagacgcagcacgggaccatcctgatcaaggtggagtacaagggcgaggacgccccctgcaagatcccgttctccaccgaggacgggcagggcaaggcgcacaacggccgcctgatcaccgccaaccccgtggtcacgaagaaggaggagcccgtgaacatcgaggccgagcccccgttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcgcgctcacgccccagcccatggagctgaagtacagctggaagacctgggggaaggccaagatcgtgacggccgagacccagaactccagcttcatcatcgacggcccgaacacccccgagtgcccctccgccagccgggcgtggaacgtgtgggaggtcgaggactacgggttcggcgtgttcaccacgaacatctggctgaagctccgcgaggtgtacacccagagctgcgaccaccggctgatgtccgccgccatcaaggacgagcgcgccgtccacgccgacatgggctactggatcgagagccagaagaacgggtcctggaagctggagaaggcgagcttcatcgaggtgaagacctgcacctggcccaagtcccacaccctctggagcaacggcgtgctggagtccgacatgatcatccccaagtccctggccgggcccatctcccagcacaaccaccggcccggctaccacacgcagaccgccgggccgtggcacctcggcaagctggagctggacttcaactactgcgagggcaccaccgtcgtgatcgccgagaactgcgggacgcgcggccccagcctccggaccaccaccgtgtccgggaagctgatccacgagtggtgctgccgcagctgcacgctgccgcccctgcggtacatgggcgaggacgggtgctggtacggcatggagatccgcccgatcaacgagaaggaggagaacatggtcaagtccctggtgagcgccggctccgggaaggtggacaacttcaccatgggcgtcctgtgcctcgcgatcctgttcgaggaggtgatgcgggggaagttcggcaagaagcacatgatcgccggggtgctgttcaccttcgtcctcctgctgagcggccagatcacctggcgcgacatggcccacacgctcatcatgatcggctccaacgccagcgaccggatggggatgggcgtgacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatgaccctcaagctgatcacccagttcgagacgtaccagctgtggaccgccctcgtctccctgacctgcagcaacaccatcttcacgctgaccgtggcctggcgcaccgccaccctcatcctggcgggggtctccctgctccccctgtgccagagctccagcatgcggaagacggactggctgccgatgaccgtggccgccatgggcgtgccgcccctccccctgttcatcttctccctgaaggacaccccgaagcgccgcagctggcccctcaacgagggggtcatggccgtgggcctggtgtccatcctggccagctccctcctgcggaacgacgtccccatggcgggccccctggtggccgggggcctcctgatcgcctgctacgtgatcaccgggacgagcgccgacctgaccgtcgagaaggccgcggacgtgacctgggaggaggaggccgagcagaccggcgtgtcccacaacctcatgatcacggtcgacgacgacgggaccatgaagatcaaggacgacgagaccgagaacatcctgaccgtgctgctcaagaccgccctgctgatcgtgagcggcatcttcccgtactccatccccgccacgctcctggtctggcacacctggcagaagcagacccagcgcagcggcgtgctgtgggacgtgcccagcccgcccgagacccagaaggccgagctcgaggagggggtctaccggatcaagcagcagggcatcttcgggaagacccaggtgggcgtgggggtccagaaggagggcgtgttccacaccatgtggcacgtgacccgcggcgcggtcctgacccacaacgggaagcggctggagcccaactgggccagcgtgaagaaggacctcatctcctacggcgggggctggcgcctgagcgcccagtggcagaagggggaggaggtgcaggtcatcgccgtggagcccggcaagaaccccaagaacttccagacgatgcccggcatcttccagaccaccaccggggagatcggcgcgatcgccctggacttcaagcccgggacgagcggctcccccatcatcaaccgggagggcaaggtggtcgggctgtacggcaacggggtggtgaccaagaacggcgggtacgtcagcggcatcgcccagaccaacgccgagccggacggccccacccccgagctcgaggaggagatgttcaagaagcgcaacctgacgatcatggacctgcaccccgggtccggcaagacccggaagtacctcccggccatcgtgcgcgaggcgatcaagcggcgcctgcggaccctgatcctcgcccccacccgcgtggtcgccgccgagatggaggaggccctgaaggggctgcccatccggtaccagacgaccgcgaccaagagcgagcacaccggccgcgagatcgtggacctcatgtgccacgccacgttcaccatgcggctgctgtcccccgtgcgcgtcccgaactacaacctcgtgatcatggacgaggcccacttcaccgaccccgccagcatcgccgcgcgggggtacatctccacccgcgtgggcatgggcgaggccgccgccatcttcatgacggcgacgccgcccgggaccgccgaggccttcccgcagagcaacgcccccatccaggacgaggagcgggacatccccgagcgctcctggaacagcggcaacgagtggatcaccgacttcgtcgggaagacggtgtggttcgtgccctccatcaaggccggcaacgacatcgcgaactgcctgcgcaagaacgggaagaaggtcatccagctgagccggaagaccttcgacaccgagtaccagaagacccgcctcaacgactgggacttcgtggtgacgaccgacatctccgagatgggcgccaacttcaaggccgaccgggtcatcgacccgcgccggtgcctgaagcccgtgatcctgaccgacggccccgagcgcgtgatcctcgccgggcccatgccggtcaccgccgcgagcgccgcccagcggcgcggccgggtggggcgcaacccccagaaggagaacgaccagtacatcttcatgggccagcccctgaacaacgacgaggaccacgcccactggacggaggccaagatgctgctcgacaacatcaacacccccgaggcgatcatcccggccctgttcgagcccgagcgggagaagtccgccgccatcgacggggagtaccgcctgaagggcgagagccggaagaccttcgtcgagctcatgcgccggggcgacctgcccgtgtggctggcgcacaaggtggcctccgaggggatcaagtacaccgaccgcaagtggtgcttcgacggcgagcggaacaaccagatcctcgaggagaacatggacgtcgagatctggaccaaggagggggagcgcaagaagctgcggccccgctggctggacgcccgcacgtacagcgacccgctcgccctgaaggagttcaaggacttcgccgcgggccggaagtccatcgccctggacctcgtgaccgagatcggccgcgtgcccagccacctggcccaccggacccgcaacgccctggacaacctcgtcatgctgcacaccagcgagcacgggggccgggcctaccgccacgcggtggaggagctgcccgagacgatggagaccctcctgctgctcgggctgatgatcctgctcaccggcggggccatgctgttcctgatctccggcaagggcatcgggaagaccagcatcggcctcatctgcgtgatcgtctccagcgggatgctgtggatggccgacgtgccgctgcagtggatcgcctccgccatcgtgctcgagttcttcatgatggtcctgctgatccccgagcccgagaagcagcggacgccccaggacaaccagctcgcgtacgtggtgatcggcatcctgaccctggccgccatcgtcgccgccaacgagatggggctcctggagaccaccaagcgcgacctgggcatgagcaaggagccgggcgtggtgtcccccacgagctacctcgacgtcgacctgcaccccgcgtccgcctggaccctgtacgccgtggccaccaccgtgatcacgcccatgctccggcacaccatcgagaacagcaccgcgaacgtctccctggccgccatcgccaaccaggccgtggtgctgatggggctcgacaagggctggccgatcagcaagatggacctgggggtccccctgctcgcgctgggctgctactcccaggtgaaccccctgaccctcacggccgccgtgctgctgctcgtcacccactacgccatcatcgggcccggcctgcaggccaaggcgacccgcgaggcccagaagcggaccgccgccggcatcatgaagaacccgacggtggacgggatcatgaccatcgacctggaccccgtgatctacgacagcaagttcgagaagcagctcggccaggtcatgctgctggtgctctgcgccgtgcagctgctgctcatgcgcacctcctgggcgctgtgcgaggccctgaccctcgccacggggcccatcaccaccctgtgggagggcagccccggcaagttctggaacaccacgatcgccgtctccatggcgaacatcttccgggggagctacctggccggcgccgggctcgccttctccatcatgaagtccgtgggcaccgggcgccggggcaccggcagccagggggagaccctgggcgagaagtggaagaagaagctgaaccagctctcccgcaaggagttcgacctgtacaagaagtccgggatcacggaggtggaccggaccgaggccaaggagggcctgaagcgcggggagaccacccaccacgcggtctcccggggcagcgccaagctccagtggttcgtggagcgcaacatggtgatcccggagggccgggtcatcgacctggggtgcggccgcgggggctggtcctactactgcgccgggctgaagaaggtgaccgaggtgcgcggctacacgaagggcgggcccggccacgaggagcccgtccccatgagcacctacgggtggaacatcgtgaagctcatgtccggcaaggacgtgttctacctgccgcccgagaagtgcgacaccctgctgtgcgacatcggggagagctcccccagccccaccgtcgaggagtcccggacgatccgcgtgctcaagatggtggagccgtggctgcggagcaaccagttctgcatcaaggtcctgaacccctacatgcccaccgtgatcgagcacctcgagcgcctgcagcggaagtacggcggcatgctggtgcgcaaccccctctcccggaacagcacccacgagatgtactggatctccaacgggaccggcaacatcgtcagctccgtgaacatggtcagccgcctgctgctcaaccggttcacgatgacccaccgccggccgaccatcgagaaggacgtggacctgggggccggcacccgccacgtgaacgccgagcccgagacgcccaacatggacgtcatcggcgagcggatcaagcgcatcaaggaggagcactccagcacctggcactacgacgacgagaacccgtacaagacctgggcgtaccacgggagctacgaggtgaaggccaccggctccgccagctccatgatcaacggggtggtcaagctgctcacgaagccctgggacgtggtgcccatggtcacccagatggccatgaccgacaccacgcccttcggccagcagcgggtgttcaaggagaaggtggacacccgcaccccgcggcccatgcccgggacccgcaaggtcatggagatcacggccgagtggctgtggcggaccctgggccgcaacaagaagccccgcctctgcacccgggaggagttcaccaagaaggtgcgcacgaacgcggccatgggcgccgtgttcaccgaggagaaccagtgggacagcgcccgggcggccgtcgaggacgaggagttctggaagctggtggacaaggagcgcgagctgcacaagctcgggaagtgcggctcctgcgtgtacaacatgatggggaagcgggagaagaagctgggcgagttcgggaaggccaagggcagccgcgccatctggtacatgtggctgggcgcccggtacctcgagttcgaggcgctggggttcctgaacgaggaccactggttctcccgcgagaacagctactccggcgtcgagggggagggcctccacaagctggggtacatcctgcgggacatcagcaagatcccgggcggcgccatgtacgccgacgacaccgccgggtgggacacccgcatcacggaggacgacctccacaacgaggagaagatcacccagcagatggaccccgagcaccggcagctggccaacgcgatcttcaagctgacctaccagaacaaggtggtgaaggtccagcgccccacccccaagggcacggtgatggacatcatctcccggaaggaccagcgcgggagcggccaggtgggcacctacgggctcaacaccttcaccaacatggaggcccagctggtccggcagatggagggcgagggggtgctgtccaaggccgacctcgagaacccgcacctcctggagaagaagatcacccagtggctcgagacgaagggcgtggagcgcctgaagcggatggccatcagcggggacgactgcgtcgtgaagcccatcgacgaccgcttcgccaacgcgctgctcgccctgaacgacatgggcaaggtgcggaaggacatcccccagtggcagccctccaagggctggcacgactggcagcaggtcccgttctgcagccaccacttccacgagctgatcatgaaggacgggcgcaagctcgtggtgccctgccggccccaggacgagctgatcggccgcgcccgcatctcccagggggccggctggagcctgaaggagaccgcctgcctcgggaaggcgtacgcccagatgtggtccctgatgtacttccaccggcgcgacctgcggctcgccagcaacgccatctgcagcgcggtccccgtgcactggatcccgacctcccgcaccacgtggagcatccacgcccaccaccagtggatgaccaccgaggacatgctgaccgtgtggaaccgggtctggatcgaggacaacccctggatggaggacaagacgcccgtgaccacctgggaggacgtgccctacctgggcaagcgcgaggaccagtggtgcggctccctcatcgggctgaccagccgggccacgtgggcccagaacatcctgaccgccatccagcaggtccgctccctcatcggcgacgaggagttcctggactacatgccgagcatgaagcggttccgcaaggaggaggagaccgagggggcgatctggtga

SEQ ID NO: 9947 - RNA, 9873 nt, synthetic construct
  misc_feature 1..9873: note = derived and/or modified CDS sequence (opt1) from DENV-3__GU131939__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtgacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccatcaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtgggcggggtcctgaactccctcggcaagatggtgcaccagatcttcgggagcgcgtacaccgccctgttctccggcgtgagctggatcatgaagatcggcatcggggtcctgctcacgtggatcggcctgaactccaagaacaccagcatgtccttcagctgcatcgtgatcgggatcatcaccctgtacctcggcgccgtggtccaggccgacatggggtgcgtgatcaactggaagggcaaggagctgaagtgcggcaacgggatcttcgtgaccaacgaggtccacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtggtcgtgggggacatcatcggcgtgctggagcagggcaagcgcaccctcacgccccagccgatggagctgaagtactcctggaagacgtgggggaaggcgaagatcgtcaccgccgagacccagaacagctccttcatcatcgacggccccaacacccccgagtgccccagcgcctcccgggcctggaacgtgtgggaggtggaggactacgggttcggcgtcttcacgaccaacatctggctgaagctccgcgaggtgtacacccagagctgcgaccaccggctgatgagcgcggccatcaaggacgagcgcgccgtgcacgccgacatgggctactggatcgagtcccagaagaacgggagctggaagctggagaaggcctccttcatcgaggtcaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtggtcatcgccgagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgcaagtcctggcccctcaacgagggggtgatggccgtcggcctggtgagcatcctggcctccagcctcctgcgcaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcggatcaaggacgacgagaccgagaacatcctgaccgtcctgctcaagacggccctgctgatcgtgtccggcatcttcccctacagcatccccgccaccctcctggtgtggcacacctggcagaagcagacccagcgctccggcgtcctgtgggacgtgcccagcccgcccgagacgcagaaggccgagctcgaggagggggtgtaccggatcaagcagcagggcatcttcgggaagacccaggtcggcgtgggggtgcagaaggagggcgtcttccacaccatgtggcacgtgacccgcggcgccgtgctgacgcacaacgggaagcggctggagcccaactgggcgtccgtcaagaaggacctcatcagctacggcgggggctggcgcctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtggggctgtacggcaacggggtcgtgaccaagaacggcgggtacgtgtccggcatcgcccagaccaacgccgagcccgacggccccacgcccgagctcgaggaggagatgttcaagaagcgcaacctgaccatcatggacctgcacccggggagcggcaagacccggaagtacctccccgccatcgtccgcgaggccatcaagcggcgcctgcggaccctgatcctcgcgcccacgcgcgtggtggccgccgagatggaggaggccctgaaggggctgcccatccggtaccagaccaccgccaccaagtccgagcacacgggccgcgagatcgtcgacctcatgtgccacgcgaccttcaccatgcggctgctgagcccggtgcgcgtgcccaactacaacctcatcatcatggacgaggcccacttcaccgaccccgcctccatcgccgcccgggggtacatcagcacgcgcgtcggcatgggcgaggcggccgccatcttcatgaccgccacgccgcccgggaccgcggaggccttcccccagtccaacgcccccatccaggacgaggagcgggacatccccgagcgcagctggaactccggcaacgagtggatcacggacttcgtggggaagaccgtgtggttcgtccccagcatcaaggccggcaacgacatcgccaactgcctgcgcaagaacgggaagcgggtgatccagctgtcccgcaagaccttcgacaccgagtaccagaagacgcggctcaacgactgggacttcgtggtcaccaccgacatcagcgagatgggcgcgaacttcaaggccgaccgcgtgatcgacccccggcgctgcctgaagcccgtgatcctgaccgacggccccgagcgggtcatcctcgccgggccgatgcccgtgacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgcaccgcacgcggaacgccctggacaacctcgtgatgctgcacaccagcgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtcatcgtgagctccggcatgctgtggatggcggacgtgcccctgcagtggatcgccagcgccatcgtcctcgagttcttcatgatggtgctgctgatccccgagcccgagaagcagcgcaccccgcaggacaaccagctcgcctacgtggtcatcgggatcctgaccctggccgcgatcgtggccgccaacgagatgggcctcctggagacgaccaagcgggacctgggcatgtccaaggagcccggggtggtcagccccacctcctacctcgacgtggacctgcaccccgccagcgcctggaccctgtacgcggtggccacgaccgtcatcaccccgatgctccgccacaccatcgagaactccacggccaacgtgagcctggccgcgatcgccaaccaggccgtggtcctgatgggcctcgacaaggggtggcccatctccaagatggacctgggcgtgcccctgctcgccctggggtgctacagccaggtgaaccccctgaccctcaccgccgcggtcctgctgctcgtgacccactacgccatcatcggcccgggcctgcaggccaaggccacgcgggaggcccagaagcgcaccgcggccgggatcatgaagaaccccaccgtggacggcatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgcgaccggccccatcaccacgctgtgggagggctccccggggaagttctggaacaccaccatcgccgtgagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtcgaccgcaccgaggccaaggaggggctgaagcggggcgagaccacgcaccacgccgtgagccgcggctccgccaagctccagtggttcgtggagcggaacatggtcatccccgaggggcgcgtgatcgacctgggctgcgggcgcggcgggtggagctactactgcgcgggcctgaagaaggtgaccgaggtccggggctacaccaagggcggccccgggcacgaggagcccgtgccgatgtccacctacggctggaacatcgtgaagctcatgagcgggaaggacgtcttctacctgccgcccgagaagtgcgacacgctgctgtgcgacatcggcgagtccagcccctccccgaccgtggaggagagccgcaccatccgggtgctcaagatggtcgagccctggctgcgcaacaaccagttctgcatcaaggtgctgaacccctacatgcccaacgtgatcgagcacctcgagcggctgcagcgcaagtacggcgggatgctggtccggaacccgctctcccgcaacagcacccacgagatgtactggatctccaacggcacggggaacatcgtgagctccgtgaacatggtcagccggctgctgctcaaccgcttcaccatgacccaccggcgccccaccatcgagaaggacgtggacctgggcgccggcacgcggcacgtcaacgccgagcccgagaccccgaacatggacgtgatcggggagcgcatcaagcggatcaaggaggagcactccagcacctggcactacgacgacgagaacccctacaagacctgggcctaccacggctcctacgaggtgaaggccacggggagcgcgagctccatgatcaacggcgtcgtgaagctgctcaccaagccctgggacgtggtccccatggtgacccagatggccatgaccgacacgaccccgttcgggcagcagcgcgtgttcaaggagaaggtcgacacccggacgccccggcccatgcccggcacgcggaaggtgatggagatcaccgccgagtggctgtggcgcaccctgggccgcaacaagaagccgcggctctgcacccgcgaggagttcacgaagaaggtgcggaccaacgccgccatgggggcggtcttcaccgaggagaaccagtgggacagcgcccgcgccgccgtggaggacgaggagttctggaagctggtggacaaggagcgggagctgcacaagctcggcaagtgcgggtcctgcgtctacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgcggacgacaccgccggctgggacacgcggatcaccgaggacgacctccacaacgaggagaagatcacccagcagatggaccccgagcaccgccagctggccaacgccatcttcaagctgacctaccagaacaaggtggtcaaggtgcagcggcccacgccgaaggggaccgtgatggacatcatctcccgcaaggaccagcggggcagcggccaggtcgggacctacggcctcaacaccttcaccaacatggaggcccagctggtgcgccagatggagggggagggcgtgctgtccgaggcggacctcgagaacccccacctcctggagaagaagatcacgcagtggctcgagaccaagggggtcgagcggctgaagcgcatggccatcagcggcgacgactgcgtggtgaagcccatcgacgaccggttcgccaacgccctgctcgccctgaacgacatgggcaaggtccgcaaggacatcccccagtggcagccgtccaaggggtggcacgactggcagcaggtccccttctgcagccaccacttccacgagctgatcatgaaggacggccggaagctcgtggtcccctgccgcccccaggacgagctgatcgggcgcgcgcggatctcccagggcgccgggtggagcctgaaggagaccgcctgcctcggcaaggcctacgcccagatgtggtccctgatgtacttccaccgccgggacctgcgcctcgcgagcaacgccatctgctccgccgtgccggtgcactggatccccaccagccggacgacctggagcatccacgcccaccaccagtggatgaccaccgaggacatgctgacggtctggaaccgcgtgtggatcgaggacaacccctggatggaggacaagacccccgtgaccacctgggaggacgtcccgtacctgggcaagcgggaggaccagtggtgcgggtccctcatcggcctgacgagccgcgcgacctgggcccagaacatcctgaccgccatccagcaggtccggtccctcatcggggacgaggagttcctggactacatgcccagcatgaagcgcttccggaaggaggaggagtccgagggcgccatctggtga

SEQ ID NO: 9948 - RNA, 9873 nt, synthetic construct
  misc_feature 1..9873: note = derived and/or modified CDS sequence (opt1) from DENV-3__GU131940__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcaccccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcaccgtcgtgcaggccgacatggggtgcgccatcaactggaagggcaaggagctgaagtgcggctccgggatcttcgtgacgaacgaggtccacacctggaccgagcagtacaagttccaggccgacagccccaagcgcctggcgaccgccatcgccggcgcctgggagaacggggtgtgcggcatccgctccacgacccggatggagaacctcctgtggaagcagatcgccaacgagctgaactacatcctctgggagaacaacatcaagctgaccgtggtcgtgggggacatcatcggcgtgctggagcagggcaagcgcaccctcacgccccagccgatggagctgaagtacagctggaagacctgggggaaggcgaagatcgtcaccgccgagacccagaactccagcttcatcatcgacggccccaacacgcccgagtgcccctccgccagccgggcctggaacgtgtgggaggtggaggactacgggttcggcgtcttcaccaccaacatctggctgaagctccgcgaggtgtacacccagagctgcgaccaccggctgatgtccgcggccatcaaggacgagcgcgccgtgcacgccgacatgggctactggatcgagagccagaagaacgggtcctggaagctggagaaggccagcttcatcgaggtcaagacctgcacgtggccgaagtcccacaccctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatcaacgagaaggaggagaacatggtgaagtccctggtcagcgccggctccgggaaggtggacaacttcacgatgggcgtgctgtgcctcgccatcctgttcgaggaggtcatgcgggggaagttcggcaagaagcacatgatcgccggggtgctgttcaccttcgtgctcctgctgagcggccagatcacctggcgcgacatggcgcacaccctcatcatgatcggctccaacgccagcgaccggatggggatgggcgtcacgtacctggccctgatcgccaccttcaagatccagcccttcctcgccctggggttcttcctgcgcaagctcaccagccgggagaacctgctgctcggcgtgggcctggcgatggccaccacgctgcagctccccgaggacatcgagcagatggccaacgggatcgccctgggcctgatgaccctcaagctgatcacccagttcgagacctaccagctgtggacggcgctcgtgtccctgacctgcagcaacaccatcttcaccctgacggtcgcctggcgcaccgccaccctcatcctggccggggtgtccctgctcccgctgtgccagagctccagcatgcggaagaccgactggctgcccatgacggtcgccgcgatgggcgtgccccccctcccgctgttcatcttctccctgaaggacacccccaagcgccgcagctggcccctcaacgagggggtgatggccgtcggcctggtgtccatcctggccagctccctcctgcggaacgacgtgcccatggccggcccgctggtcgccgggggcctcctgatcgcgtgctacgtgatcaccgggaccagcgccgacctgacggtggagaaggccgccgacgtcacctgggaggaggaggccgagcagaccggcgtgtcccacaacctcatgatcaccgtggacgacgacgggaccatgcgcatcaaggacgacgagacggagaacatcctgaccgtcctgctcaagaccgcgctgctgatcgtgagcggcatcttcccctactccatccccgccaccctcctggtgtggcacacgtggcagaagcagacccagcggagcggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacacgatgtggcacgtgacccggggcgccgtgctgacccacaacgggaagcgcctggagcccaactgggccagcgtcaagaaggacctcatctcctacggcgggggctggcggctgaacgcgcagtggcagaagggggaggaggtgcaggtgatcgccgtcgagcccggcaagaacccgaagaacttccagaccatgcccggcatcttccagacgaccaccggggagatcggcgccatcgccctggacttcaagcccgggaccagcggcagcccgatcatcaaccgcgagggcaaggtggtggggctgtacggcaacggggtcgtgacgaagaacggcgggtacgtgtccggcatcgcgcagaccaacgccgagcccgacggccccacccccgagctcgaggaggagatgttcaagaagcggaacctgaccatcatggacctgcacccggggagcggcaagacgcgcaagtacctccccgccatcgtccgggaggccatcaagcgccggctgcgcaccctgatcctcgcccccacccgggtggtggcggccgagatggaggaggccctgaaggggctgcccatccgctaccagaccacggccaccaagtccgagcacaccggccgggagatcgtcgacctcatgtgccacgccaccttcacgatgcgcctgctgagcccggtgcgggtgcccaactacaacctcgtcatcatggacgaggcgcacttcaccgaccccgcctccatcgccgcccgcgggtacatcagcacccgggtgggcatgggcgaggccgcggccatcttcatgaccgccacgcccccggggaccgccgaggcgttcccccagtccaacgcccccatccaggacgaggagcgcgacatccccgagcgcagctggaactccggcaacgagtggatcaccgacttcgtggggaagaccgtctggttcgtgccgagcatcaaggccggcaacgacatcgccaactgcctgcggaagaacgggaagaaggtgatccagctgtcccgcaagacgttcgacaccgagtaccagaagacccggctcaacgactgggacttcgtcgtgaccacggacatcagcgagatgggcgccaacttcaaggcggaccgcgtgatcgacccccggcgctgcctgaagcccgtcatcctgaccgacggccccgagcgggtgatcctcgccgggccgatgcccgtgaccgccgcctccgccgcgcagcgccggggccgcgtcgggcggaacccccagaaggagaacgaccagtacatcttcaccggccagcccctgaacaacgacgaggaccacgcccactggaccgaggccaagatgctgctcgacaacatcaacacgccggaggggatcatccccgccctgttcgagcccgagcgcgagaagagcgccgcgatcgacggcgagtaccggctgaagggcgagtcccgcaagaccttcgtggagctcatgcggcgcggggacctgcccgtctggctggcctacaaggtggccagcgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcccggacgtactccgaccccctcgcgctgaaggagttcaaggacttcgccgccggccgcaagagcatcgccctggacctcgtcaccgagatcgggcgggtgccctcccacctggcccaccgcacccggaacgcgctggacaacctcgtgatgctgcacaccagcgagcacggcgggcgcgcctaccggcacgccgtcgaggagctgccggagacgatggagaccctcctgctgctcggcctgatgatcctgctcaccgggggcgccatgctgttcctgatcagcggcaaggggatcggcaagacctccatcgggctcatctgcgtgatcgtgagctccggcatgctgtggatggccgacgtccccctgcagtggatcgcgagcgccatcgtgctcgagttcttcatgatggtgctgctgatccccgagcccgagaagcagcgcacgccgcaggacaaccagctcgcctacgtcgtgatcgggatcctgaccctggccgccatcgtggcggccaacgagatgggcctcctggagaccaccaagcgggacctgggcatgtccaaggagcccggggtcgtgagccccacgtcctacctcgacgtggacctgcaccccgccagcgcctggaccctgtacgccgtcgcgaccaccgtgatcacgccgatgctccgccacaccatcgagaactccaccgccaacgtgagcctggccgccatcgcgaaccaggccgtcgtgctgatgggcctcgacaaggggtggcccatctccaagatggacctgggcgtgcccctgctcgccctggggtgctacagccaggtcaaccccctgaccctcacggccgccgtgctgctgctcgtgacccactacgcgatcatcggcccgggcctgcaggccaaggccacccgggaggcccagaagcgcaccgccgcggggatcatgaagaaccccacggtcgacggcatcatgaccatcgacctggaccccgtgatctacgactccaagttcgagaagcagctcgggcaggtgatgctgctggtcctctgcgccgtgcagctgctgctcatgcggaccagctgggccctgtgcgaggccctgaccctcgccacgggccccatcaccaccctgtgggagggctccccggggaagttctggaacaccacgatcgcggtgagcatggccaacatcttccgcggctcctacctggccggggccggcctcgcgttcagcatcatgaagtccgtcgggaccggccggcgcggcaccgggagccagggcgagaccctgggggagaagtggaagaagaagctgaaccagctcagccggaaggagttcgacctgtacaagaagtccggcatcaccgaggtggaccgcacggaggccaaggaggggctgaagcggggcgagaccacccaccacgccgtgagccgcggctccgccaagctccagtggttcgtcgagcggaacatggtgatccccgaggggcgcgtgatcgacctgggctgcgggcgcggcgggtggagctactactgcgccggcctgaagaaggtcaccgaggtgcggggctacacgaaggggggccccgggcacgaggagcccgtgccgatgtccacctacggctggaacatcgtcaagctcatgagcgggaaggacgtgttctacctgccccccgagaagtgcgacaccctgctgtgcgacatcggcgagtccagcccctccccgaccgtggaggagagccgcacgatccgggtcctcaagatggtggagccctggctgcgcaacaaccagttctgcatcaaggtgctgaacccctacatgcccaccgtcatcgagcacctcgagcggctgcagcgcaagtacggcgggatgctggtgcggaacccgctctcccgcaacagcacccacgagatgtactggatctccaacggcaccgggaacatcgtgagctccgtcaacatggtgagccggctgctgctcaaccgcttcacgatgacccaccggcgccccaccatcgagaaggacgtcgacctgggcgcgggcacccggcacgtgaacgccgagcccgagacgccgaacatggacgtgatcggggagcgcatcaagcggatcaaggaggagcactccagcacctggcactacgacgacgagaacccctacaagacctgggcctaccacggctcctacgaggtcaaggccaccgggagcgccagctccatgatcaacggcgtggtgaagctgctcacgaagccctgggacgtcgtgcccatggtgacccagatggcgatgaccgacaccacgccgttcgggcagcagcgcgtcttcaaggagaaggtggacacccggaccccccgccccatgcccggcacccggaaggtgatggagatcacggccgagtggctgtggcgcaccctgggccgcaacaagaagccgcggctctgcacccgcgaggagttcaccaagaaggtccggacgaacgccgccatgggggccgtgttcaccgaggagaaccagtgggacagcgcgcgcgccgccgtggaggacgaggagttctggaagctggtcgaccgggagcgcgagctgcacaagctcggcaagtgcgggtcctgcgtgtacaacatgatgggcaagcgggagaagaagctgggggagttcggcaaggccaagggcagccgcgcgatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgccgacgacaccgcgggctgggacacccgcatcacggaggacgacctccacaacgaggagaagatcacccagcagatggaccccgagcaccggcagctggccaacgccatcttcaagctgacctaccagaacaaggtcgtgaaggtgcagcgccccaccccgaaggggaccgtcatggacatcatctcccggaaggaccagcgcggcagcggccaggtggggacgtacggcctcaacaccttcaccaacatggaggcccagctggtgcggcagatggagggggagggcgtcctgtccaaggccgacctcgagaacccccacctgctggagaagaagatcacccagtggctcgagacgaagggggtggagcgcctgaagcggatggcgatcagcggcgacgactgcgtggtcaagcccatcgacgaccgcttcgccaacgccctgctcgccctgaacgacatgggcaaggtgcggaaggacatcccccagtggcagccgtccaaggggtggcacgactggcagcaggtgcccttctgcagccaccacttccacgagctgatcatgaaggacggccgcaagctcgtcgtgccctgccgcccccaggacgagctgatcgggcgggcccgcatctcccagggcgcggggtggagcctgaaggagaccgcctgcctcggcaaggcctacgcccagatgtggtccctgatgtacttccaccggcgcgacctgcggctcgccagcaacgcgatctgctccgccgtgccggtccactggatccccaccagccgcaccacgtggagcatccacgcccaccaccagtggatgaccaccgaggacatgctgaccgtgtggaaccgggtgtggatcgaggacaacccctggatggaggacaagacgcccgtcaccacctgggaggacgtgccgtacctgggcaagcgcgaggaccagtggtgcgggtccctcatcggcctgaccagccgggccacgtgggcgcagaacatcctgaccgccatccagcaggtgcgctccctcatcggggacgaggagttcctggactacatgcccagcatgaagcggttccgcaaggaggaggagtccgagggcgccatctggtga

SEQ ID NO: 9949 - RNA, 9873 nt, synthetic construct
  misc_feature 1..9873: note = derived and/or modified CDS sequence (opt1) from DENV-3__GU131942__SS-prME
  source 1..9873: mol_type = other RNA
accagcctgtgcctcatgatgatgttccccgccaccctggccttccacctgacgtcccgcgacggcgagccgcggatgatcgtggggaagaacgagcgcggcaagagcctcctgttcaagaccgcgtccgggatcaacatgtgcaccctgatcgccatggacctcggcgagatgtgcgacgacaccgtcacgtacaagtgccccctgatcgccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagagcaagcccaccctcgacatcgagctgcagaagaccgaggccacccagctggcgacgctccggaagctgtgcatcgagggcaagatcaccaacatcaccaccgactcccgctgccccacgcagggcgaggccaccctgccggaggagcaggaccagaactacgtgtgcaagcacacctacgtcgaccgggggtggggcaacgggtgcggcctcttcgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgacacccagggggtgacggtcgagatcaccccccaggcctccaccgtggaggccgtgctgcccgagtacggcaccctggggctcgagtgcagcccgcgcaccggcctggacttcaacgagatgatcctgctcacgatgaagaacaaggcgtggatggtccaccggcagtggttcttcgacctgcccctgccctggacctccggcgccaccaccgagacgcccacctggaaccgcaaggagctcctggtgaccttcaagaacgcccacgccaagaagcaggaggtggtcgtgctggggagccaggagggcgccatgcacaccgcgctcacgggggccaccgagatccagaactccggcgggaccagcatcttcgccggccacctgaagtgccggctgaagatggacaagctcgagctgaagggcatgtcctacgccatgtgcctgaacaccttcgtgctcaagaaggaggtcagcgagacgcagcacgggaccatcctgatcaaggtggagtacaagggcgaggacgccccgtgcaagatccccttcagcaccgaggacgggcagggcaaggcgcactccggccgcctgatcaccgccaaccccgtggtcacgaagaaggaggagcccgtgaacatcgaggccgagccgcccttcggggagagcaacatcgtgatcggcatcggggacaaggccctgaagatcaactggtacaagaagggctccagcatcgggaagatgttcgaggcgaccgcccggggcgcccgccggatggccatcctcggcgacaccgcctgggacttcgggtccgtcggcggggtgctgaacagcctgggcaagatggtgcaccagatcttcgggtccgcgtacaccgccctcttcagcggcgtctcctgggtgatgaagatcggcatcggggtgctgctgacgtggatcggcctcaacagcaagaacacctccatgagcttctcctgcatcgtcatcgggatcatcaccctgtacctgggcgccgtggtgcaggccgacatggggtgcgtcatcaactggaagggcaaggagctcaagtgcggcagcgggatcttcgtgaccaacgaggtgcacacgtggaccgagcagtacaagttccaggccgactcccccaagcgcctggcgaccgccatcgccggcgcctgggagaacggggtctgcggcatccgcagcaccacgcggatggagaacctgctctggaagcagatcgccaacgagctgaactacatcctgtgggagaacaacatcaagctcaccgtggtggtcggggacatcatcggcgtgctggagcagggcaagcgcaccctgaccccccagccgatggagctcaagtactcctggaagacgtgggggaaggcgaagatcgtgaccgccgagacccagaacagctccttcatcatcgacggccccaacacccccgagtgccccagcgccagccgggcctggaacgtctgggaggtggaggactacgggttcggcgtgttcacgaccaacatctggctgaagctgcgcgaggtctacacccagtcctgcgaccaccggctcatgagcgcggccatcaaggacgagcgcgccgtgcacgccgacatgggctactggatcgagtcccagaagaacgggagctggaagctggagaaggcctccttcatcgaggtgaagacctgcacctggccgaagagccacacgctgtggtccaacggcgtcctcgagagcgacatgatcatccccaagtccctggcggggcccatcagccagcacaaccaccggccgggctaccacacccagaccgccgggccctggcacctgggcaagctcgagctggacttcaactactgcgagggcaccacggtggtgatcaccgagaactgcgggacccgcggcccctccctgcggaccacgaccgtcagcgggaagctcatccacgagtggtgctgccgctcctgcaccctgcccccgctgcggtacatgggcgaggacgggtgctggtacggcatggagatccgccccatcaacgagaaggaggagaacatggtgaagagcctcgtgtccgccggcagcgggaaggtcgacaacttcaccatgggcgtgctgtgcctggccatcctcttcgaggaggtgatgcgggggaagttcggcaagaagcacatgatcgccggggtcctgttcacgttcgtgctgctcctgtccggccagatcacctggcgcgacatggcgcacaccctgatcatgatcggcagcaacgccagcgaccggatggggatgggcgtgacctacctcgccctgatcgccacgttcaagatccagcccttcctggccctcgggttcttcctgcgcaagctgacctcccgggagaacctcctgctgggcgtcggcctcgcgatggccaccaccctgcagctgcccgaggacatcgagcagatggccaacgggatcgccctcggcctgatgacgctgaagctcatcacccagttcgagacctaccagctgtggaccgcgctggtgagcctcacgtgctccaacaccgtcttcaccctgaccgtggcctggcgcacggccaccctgatcctcgccggggtgagcctgctgccgctctgccagtccagctccatgcggaagaccgactggctgcccatgaccgtcgccgcgatgggcgtgccccccctgccgctcttcatcttcagcctgaaggacacgcccaagcgccgctcctggcccctgaacgagggggtgatggccgtcggcctcgtgagcatcctggcctccagcctgctccggaacgacgtgcccatggccggcccgctggtcgccgggggcctgctcatcgcgtgctacgtgatcaccgggacctccgccgacctgaccgtggagaaggccgccgacgtcacgtgggaggaggaggccgagcagaccggcgtgagccacaacctgatgatcaccgtggacgacgacgggaccatgcgcatcaaggacgacgagaccgagaacatcctcacggtcctgctgaagaccgcgctcctgatcgtgtccggcatcttcccctacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgccgtgctcacccacaacgggaagcgcctggagcccaactgggcctccgtcaagaaggacctgatcagctacggcgggggctggcggctcaacgcgcagtggcagaagggggaggaggtgcaggtgatcgccgtcgagcccggcaagaacccgaagaacttccagaccatgcccggcatcttccagaccacgaccggggagatcggcgccatcgccctggacttcaagcccgggaccagcggctccccgatcatcaaccgcgagggcaaggtggtggggctgtacggcaacggggtcgtgaccaagaacggcgggtacgtgagcggcatcgcgcagacgaacgccgagcccgacggccccacccccgagctggaggaggagatgttcaagaagcggaacctcaccatcatggacctgcacccggggtccggcaagacccgcaagtacctgcccgccatcgtccgggaggccatcaagcgccggctccgcacgctgatcctggcccccacccgggtggtggcggccgagatggaggaggccctcaaggggctgcccatccgctaccagaccaccgccacgaagagcgagcacaccggccgggagatcgtcgacctgatgtgccacgccaccttcaccatgcgcctcctgtccccggtgcgggtgcccaactacaacctggtcatcatggacgaggcgcacttcacggaccccgccagcatcgccgcccgcgggtacatctccacccgggtgggcatgggcgaggccgcggccatcttcatgaccgccacccccccggggacggccgaggcgttcccccagagcaacgcccccatccaggacgaggagcgcgacatccccgagcgctcctggaacagcggcaacgagtggatcaccgacttcgtggggaagaccgtctggttcgtgccgtccatcaaggccggcaacgacatcgccaactgcctccggaagaacgggaagaaggtgatccagctgagccgcaagaccttcgacacggagtaccagaagacccggctgaacgactgggacttcgtcgtgaccaccgacatctccgagatgggcgccaacttcaaggcggaccgcgtgatcgacccccggcgctgcctcaagcccgtcatcctgacggacggccccgagcgggtgatcctggccgggccgatgcccgtcaccgccgccagcgccgcgcagcgccggggccgcgtggggcggaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgcgagaagtccgccgcgatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacggggagcgcaacaaccagatcctggaggagaacatggacgtggagatctggaccaaggagggcgagcggaagaagctccgcccgcgctggctggacgcccggacctacagcgaccccctggcgctcaaggagttcaaggacttcgccgccggccgcaagtccatcgccctggacctggtcacggagatcgggcgggtgcccagccacctcgcccaccgcacccggaacgcgctggacaacctggtgatgctccacaccagcgagcacggcgggcgcgcctaccggcacgccgtcgaggagctgccggagaccatggagacgctgctcctgctgggcctcatgatcctgctgaccgggggcgccatgctcttcctgatctccggcaaggggatcggcaagaccagcatcgggctgatctgcgtgatcgtgtccagcggcatgctctggatggccgacgtccccctgcagtggatcgcgtccgccatcgtgctggagttcttcatgatggtgctcctgatccccgagcccgagaagcagcgcaccccgcaggacaaccagctggcctacgtcgtgatcgggatcctcacgctggccgccatcgtggcggccaacgagatgggcctgctcgagaccaccaagcgggacctgggcatgagcaaggagcccggggtcgtgtcccccaccagctacctggacgtggacctccaccccgcctccgcctggacgctgtacgccgtcgcgaccaccgtgatcaccccgatgctgcgccacacgatcgagaacagcaccgccaacgtgtccctcgccgccatcgcgaaccaggccgtcgtgctgatgggcctggacaaggggtggcccatcagcaagatggacctcggcgtgcccctgctggccctcgggtgctactcccaggtcaaccccctgaccctgaccgccgccgtgctcctgctggtgacgcactacgcgatcatcggcccgggcctccaggccaaggccacccgggaggcccagaagcgcaccgccgcggggatcatgaagaaccccaccgtcgacggcatcatgacgatcgacctggaccccgtgatctacgacagcaagttcgagaagcagctggggcaggtgatgctcctggtcctgtgcgccgtgcagctcctgctgatgcggacctcctgggccctctgcgaggccctgaccctggccaccggccccatcacgaccctctgggagggcagcccggggaagttctggaacaccaccatcgcggtgtccatggccaacatcttccgcggcagctacctggccggggccggcctggcgttctccatcatgaagagcgtcggggccggccggcgcggcacggggagccagggcgagaccctcggggagaagtggaagaagaagctgaaccagctgtcccggaaggagttcgacctctacaagaagagcggcatcaccgaggtggaccgcaccgaggccaaggaggggctgaagcggggcgagaccacgcaccacgccgtgtcccgcggcagcgccaagctgcagtggttcgtcgagcggaacatggtgatccccgaggggcgcgtgatcgacctcggctgcgggcgcggcgggtggtcctactactgcgcgggcctgaagaaggtcaccgaggtgcggggctacaccaaggggggccccgggcacgaggagcccgtgccgatgagcacctacggctggaacatcgtcaagctgatgtccgggaaggacgtgttctacctcccccccgagaagtgcgacacgctgctgtgcgacatcggcgagagctcccccagcccgaccgtggaggagtcccgcaccatccgggtcctgaagatggtggagccctggctccgcaacaaccagttctgcatcaaggtgctgaacccctacatgcccaccgtcatcgagcacctggagcggctccagcgcaagtacggcgggatgctggtgcggaacccgctgagccgcaactccacgcacgagatgtactggatcagcaacggcaccgggaacatcgtctccagcgtgaacatggtgtcccggctcctgctgaaccgcttcaccatgacccaccggcgccccacgatcgagaaggacgtcgacctcggcgccggcacccggcacgtgaacgccgagcccgagaccccgaacatggacgtgatcggggagcgcatcaagcggatcaaggaggagcacagctccacctggcactacgacgacgagaacccctacaagacgtgggcctaccacggcagctacgaggtcaaggccaccgggagcgcgtccagcatgatcaacggcgtggtgaagctgctgaccaagccctgggacgtcgtgcccatggtgacccagatggccatgacggacaccaccccgttcgggcagcagcgcgtcttcaaggagaaggtggacacccggacgccccgccccatgcccggcacccggaaggtgatggagatcaccgccgagtggctctggcgcaccctgggccgcaacaagaagccgcggctgtgcacgcgcgaggagttcaccaagaaggtccggaccaacgccgccatgggggcggtgttcaccgaggagaaccagtgggactccgcccgcgccgccgtggaggacgaggagttctggaagctcgtcgaccgggagcgcgagctgcacaagctgggcaagtgcgggagctgcgtgtacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgcggacgacacggccggctgggacacccgcatcaccgaggacgacctgcacaacgaggagaagatcacccagcagatggaccccgagcaccggcagctcgccaacgccatcttcaagctgacgtaccagaacaaggtcgtgaaggtgcagcgccccaccccgaaggggaccgtcatggacatcatcagccggaaggaccagcgcggctccggccaggtggggacctacggcctgaacaccttcacgaacatggaggcccagctcgtgcggcagatggagggggagggcgtcctgagcaaggcggacctggagaacccccacctcctggagaagaagatcacccagtggctggagaccaagggggtggagcgcctcaagcggatggccatctccggcgacgactgcgtggtcaagcccatcgacgaccgcttcgccaacgccctgctggccctcaacgacatgggcaaggtgcggaaggacatcccccagtggcagccgagcaaggggtggcacgactggcagcaggtgcccttctgctcccaccacttccacgagctgatcatgaaggacggccgcaagctggtcgtgccctgccgcccccaggacgagctcatcgggcgggcgcgcatcagccagggcgccgggtggtccctgaaggagaccgcctgcctgggcaaggcctacgcccagatgtggagcctcatgtacttccaccggcgcgacctgcggctggcgtccaacgccatctgcagcgccgtgccggtccactggatccccacgagccgcaccacctggtccatccacgcccaccaccagtggatgaccacggaggacatgctcaccgtgtggaaccgggtgtggatcgaggacaacccctggatggaggacaagacccccgtcaccacgtgggaggacgtgccgtacctgggcaagcgcgaggaccagtggtgcgggagcctgatcggcctcacctcccgggcgacctgggcccagaacatcctgaccgccatccagcaggtgcgcagcctgatcggggacgaggagttcctcgactacatgccctccatgaagcggttccgcaaggaggaggagagcgagggcgccatctggtga

SEQ ID NO: 9950 - RNA, 9873 nt, synthetic construct
  misc_feature 1..9873: note = derived and/or modified CDS sequence (opt1) from DENV-3__GU131943__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccatctggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagtccaacatcgtgatcggcatcggggacaaggccctcaagatcaactggtacaagaagggcagctccatcgggaagatgttcgaggcgacggcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgccatcaactggaagggcaaggagctgaagtgcggctccgggatcttcgtgaccaacgaggtccacacctggacggagcagtacaagttccaggcggacagccccaagcgcctggccaccgccatcgccggcgcctgggagaacggggtgtgcggcatccgctccaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtacagctggaagacctgggggaaggccaagatcgtcacggccgagacccagaactccagcttcatcatcgacggccccaacacccccgagtgcccctccgccagccgggcgtggaacgtgtgggaggtggaggactacgggttcggcgtcttcaccacgaacatctggctgaagctccgcgaggtgtacacccagagctgcgaccaccggctgatgtccgccgccatcaaggacgagcgcgccgtgcacgccgacatgggctactggatcgagagccagaagaacgggtcctggaagctggagaaggcgagcttcatcgaggtcaagacctgcacctggccgaagtcccacaccctctggagcaacggcgtgctggagtccgacatgatcatccccaagagcctggccgggcccatctcccagcacaaccaccggccgggctaccacacgcagaccgccgggccctggcacctcggcaagctggagctggacttcaactactgcgagggcaccaccgtggtcatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtgaagtccctggtcagcgccggctccgggaaggtggacaacttcaccatgggcgtgctgtgcctcgccatcctgttcgaggaggtcatgcgggggaagttcggcaagaagcacatgatcgcgggggtgctgttcaccttcgtgctcctgctgagcggccagatcacgtggcgcgacatggcccacaccctcatcatgatcggctccaacgccagcgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtgggccgccctcgtgtccctgacctgcagcaacaccatcttcacgctgaccgtcgcctggcgcaccgccaccctcatcctggcgggggtgtccctgctcccgctgtgccagagctccagcatgcggaagacggactggctgcccatgaccgtcgccgccatgggcgtgccgcccctgccgctgttcatcttctccctgaaggacacccccaagcgccgcagctggcccctcaacgagggggtgatggccgtcggcctggtgtccatcctggccagctccctcctgcggaacgacgtgcccatggcgggcccgctggtcgccgggggcctcctgatcgcctgctacgtgatcaccgggacgagcgccgacctgaccgtggagaaggccgcggacgtcacctgggaggaggaggccgagcagaccggcgtgtcccacaacctcatgatcacggtggacgacgacgggaccatgcgcatcaaggacgacgagaccgagaacatcctgaccgtcctgctcaagaccgccctgctgatcgtgagcggcatcttcccctactccatccccgccacgctcctggtgtggcacacctggcagaagcagacccagcggagcggcgtcctgtgggacgtgccctccccgcccgagacccagaaggccgagctcgaggagggggtgtaccgcatcaagcagcagggcatcttcgggaagacgcaggtcggcgtgggggtgcagaaggagggcgtcttccacaccatgtggcacgtgacccggggcgcggtgctgacccacaacgggaagcgcctggagcccaactgggccagcgtcaagaaggacctcatctcctacggcgggggctggcggctgaacgcccagtggcagaagggggaggaggtccaggtgatcgccgtcgagcccggcaagaacccgaagaacttccagacgatgcccggcatcttccagaccaccaccggggagatcggcgcgatcgccctggacttcaagcccgggacgagcggcagcccgatcatcaaccgcgagggcaaggtggtggggctgtacggcaacggggtcgtgaccaagaacggcgggtacgtgtccggcatcgcccagaccaacgccgagcccgacggccccacccccgagctcgaggaggagatgttcaagaagcggaacctgacgatcatggacctgcacccggggagcggcaagacccgcaagtacctccccgccatcgtccgggaggcgatcaagcgccggctgcgcaccctgatcctcgcccccacccgggtggtggccgccgagatggaggaggccctgaaggggctgcccatccgctaccagacgaccgcgaccaagtccgagcacaccggccgggagatcgtcgacctcatgtgccacgccacgttcaccatgcgcctgctgagcccggtgcgggtgcccaactacaacctcgtcatcatggacgaggcccacttcaccgaccccgcctccatcgccgcgcgcgggtacatcagcacccgggtgggcatgggcgaggccgccgccatcttcatgacggcgacgccgcccgggaccgccgaggccttcccccagtccaacgcccccatccaggacgaggagcgcgacatccccgagcgcagctggaactccggcaacgagtggatcaccgacttcgtggggaagacggtctggttcgtgcccagcatcaaggccggcaacgacatcgcgaactgcctgcggaagaacgggaagaaggtgatccagctgtcccgcaagaccttcgacaccgagtaccagaagacccggctcaacgactgggacttcgtcgtgacgaccgacatcagcgagatgggcgccaacttcaaggccgaccgcgtgatcgacccccggcgctgcctgaagcccgtcatcctgaccgacggccccgagcgggtgatcctcgccgggccgatgcccgtgaccgccgcgtccgccgcccagcgccggggccgcgtcgggcggaacccccagaaggagaacgaccagtacatcttcacgggccagcccctgaacaacgacgaggaccacgcccactggaccgaggccaagatgctgctcgacaacatcaacaccccggaggggatcatccccgcgctgttcgagcccgagcgcgagaagtccgccgccatcgacggcgagtaccggctgaagggcgagtcccgcaagaccttcgtggagctcatgcggcgcggggacctgcccgtctggctggcccacaaggtggcgagcgagggcatcaagtacaccgaccggaagtggtgcttcgacggggagcgcaacaaccagatcctcgaggagaacatggacgtggagatctggacgaaggagggcgagcggaagaagctgcgcccgcgctggctggacgcccggacctactccgaccccctcgccctgaaggagttcaaggacttcgccgccggccgcaagagcatcgcgctggacctcgtcaccgagatcgggcgggtgccctcccacctggcccaccgcacccggaacgccctggacaacctcgtgatgctgcacacgagcgagcacggcgggcgcgcctaccggcacgccgtcgaggagctgccggagaccatggagaccctcctgctgctcggcctgatgatcctgctcaccgggggcgcgatgctgttcctgatcagcggcaaggggatcggcaagacgtccatcgggctcatctgcgtgatcgtgagctccggcatgctgtggatggccgacgtccccctgcagtggatcgccagcgccatcgtgctcgagttcttcatgatggtgctgctgatccccgagcccgagaagcagcgcaccccgcaggacaaccagctcgcctacgtcgtgatcgggatcctgaccctggcggccatcgtggccgccaacgagatgggcctcctggagaccacgaagcgggacctgggcatgtccaaggagcccggggtcgtgagccccacctcctacctcgacgtggacctgcaccccgccagcgcgtggaccctgtacgccgtcgccaccacggtgatcaccccgatgctccgccacaccatcgagaactccaccgccaacgtgagcctggcggccatcgccaaccaggccgtcgtgctgatgggcctcgacaaggggtggcccatctccaagatggacctgggcgtgcccctgctcgccctggggtgctacagccaggtcaaccccctgacgctcaccgcggccgtgctgctgctcgtgacccactacgccatcatcggcccgggcctgcaggccaaggccacccgggaggcgcagaagcgcacggccgccgggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcggaccagctgggccctgtgcgaggcgctgacgctcgccaccggccccatcaccaccctgtgggagggctccccggggaagttctggaacacgaccatcgccgtgagcatggccaacatcttccgcggctcctacctggcgggggccggcctcgccttcagcatcatgaagtccgtcgggaccggccggcgcggcaccgggagccagggcgagacgctgggggagaagtggaagaagaagctgaaccagctcagccggaaggagttcgacctgtacaagaagtccggcatcaccgaggtggaccgcaccgaggccaaggaggggctgaagcggggcgagaccacccaccacgccgtgagccgcggctccgcgaagctccagtggttcgtcgagcggaacatggtgatccccgaggggcgcgtgatcgacctgggctgcgggcgcggcgggtggagctactactgcgccggcctgaagaaggtcacggaggtgcggggctacaccaagggcgggcccgggcacgaggagcccgtgccgatgtccacctacggctggaacatcgtcaagctcatgagcgggaaggacgtgttctacctgccgcccgagaagtgcgacaccctgctgtgcgacatcggcgagtccagcccctccccgacggtggaggagagccgcaccatccgggtcctcaagatggtggagccctggctgcgcaacaaccagttctgcatcaaggtgctgaacccctacatgcccaccgtcatcgagcacctcgagcggctgcagcgcaagtacggcgggatgctggtgcggaacccgctctcccgcaacagcacccacgagatgtactggatctccaacggcacggggaacatcgtgagctccgtcaacatggtgagccggctgctgctcaaccgcttcaccatgacccaccggcgccccaccatcgagaaggacgtcgacctgggcgccggcacgcggcacgtgaacgccgagcccgagaccccgaacatggacgtgatcggggagcgcatcaagcggatcaaggaggagcactccagcacctggcactacgacgacgagaacccctacaagacctgggcctaccacggctcctacgaggtcaaggcgacggggagcgccagctccatgatcaacggcgtggtgaagctgctcaccaagccctgggacgtcgtgcccatggtgacccagatggccatgaccgacacgaccccgttcgggcagcagcgcgtcttcaaggagaaggtggacacccggacgccccggcccatgcccggcacgcggaaggtgatggagatcaccgccgagtggctgtggcgcaccctgggccgcaacaagaagccgcggctctgcacccgcgaggagttcacgaagaaggtccggaccaacgccgcgatgggggccgtgttcaccgaggagaaccagtgggacagcgcccgcgccgcggtggaggacgaggagttctggaagctggtcgaccgggagcgcgagctgcacaagctcggcaagtgcgggtcctgcgtgtacaacatgatgggcaagcgggagaagaagctgggggagttcggcaaggccaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggcgatgtacgccgacgacaccgccggctgggacacgcgcatcaccgaggacgacctccacaacgaggagaagatcacccagcagatggaccccgagcaccggcagctggccaacgccatcttcaagctgacctaccagaacaaggtcgtgaaggtgcagcgccccacgccgaaggggaccgtcatggacatcatctcccggaaggaccagcgcggcagcggccaggtggggacctacggcctcaacaccttcaccaacatggaggcgcagctggtgcggcagatggagggggagggcgtcctgtccaaggccgacctcgagaacccccacctcctggagaagaagatcacgcagtggctcgagaccaagggggtggagcgcctgaagcggatggccatcagcggcgacgactgcgtggtcaagcccatcgacgaccgcttcgccaacgccctgctcgcgctgaacgacatgggcaaggtgcggaaggacatcccccagtggcagccgtccaaggggtggcacgactggcagcaggtccccttctgcagccaccacttccacgagctgatcatgaaggacggccgcaagctcgtcgtgccctgccgcccccaggacgagctgatcgggcgggcccgcatctcccagggcgccgggtggagcctgaaggagaccgcctgcctcggcaaggcctacgcgcagatgtggtccctgatgtacttccaccggcgcgacctgcggctcgccagcaacgccatctgctccgccgtgccggtccactggatccccaccagccgcacgacctggagcatccacgcgcaccaccagtggatgaccaccgaggacatgctgacggtgtggaaccgggtgtggatcgaggacaacccctggatggaggacaagacccccgtcaccacctgggaggacgtgccgtacctgggcaagcgcgaggaccagtggtgcgggtccctcatcggcctgacgagccgggccacctgggcccagaacatcctgaccgccatccagcaggtccgctccctcatcggggacgaggagttcctggactacatgcccagcatgaagcggttccgcaaggaggaggagtccgagggcgccatctggtga

SEQ ID NO: 9951 - RNA, 9873 nt, synthetic construct
  misc_feature 1..9873: note = derived and/or modified CDS sequence (opt1) from DENV-3__GU131945__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagtccatcgagggcaaggtggtccagtacgagaacctgaagtacacggtgatcatcaccgtgcacaccggggaccagcaccaggtcggcaacgacacccagggggtgacggtcgagatcacgccccaggccagcaccgtggaggccgtgctgcccgagtacggcaccctcgggctggagtgcagcccccggaccggcctggacttcaacgagatgatcctcctgacgatgaagaacaaggcgtggatggtccaccggcagtggttcttcgacctgccgctcccctggaccagcggcgccaccaccgagacgcccacctggaaccgcaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtcagcgagacgcagcacgggaccatcctgatcaaggtggagtacaagggcgaggacgccccctgcaagatcccgttctccaccgaggacgggcagggcaaggcgcacaacggccgcctgatcaccgccaaccccgtggtcacgaagaaggaggagcccgtgaacatcgaggccgagcccccgttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcgcgctcacgccccagcccatggagctgaagtacagctggaagacctgggggaaggccaagatcgtgacggccgagacccagaactccagcttcatcatcgacggcccgaacacccccgagtgcccctccgccagccgggcgtggaacgtgtgggaggtcgaggactacgggttcggcgtgttcaccacgaacatctggctgaagctccgcgaggtgtacacccagagctgcgaccaccggctgatgtccgccgccatcaaggacgagcgcgccgtccacgccgacatgggctactggatcgagagccagaagaacgggtcctggaagctggagaaggcgagcttcatcgaggtgaagacctgcacctggcccaagtcccacaccctctggagcaacggcgtgctggagtccgacatgatcatccccaagtccctggccgggcccatctcccagcacaaccaccggcccggctaccacacgcagaccgccgggccgtggcacctcggcaagctggagctggacttcaactactgcgagggcaccaccgtcgtgatcgccgagaactgcgggacgcgcggccccagcctccggaccaccaccgtgtccgggaagctgatccacgagtggtgctgccgcagctgcacgctgccgcccctgcggtacatgggcgaggacgggtgctggtacggcatggagatccgcccgatcaacgagaaggaggagaacatggtcaagtccctggtgagcgccggctccgggaaggtggacaacttcaccatgggcgtcctgtgcctcgcgatcctgttcgaggaggtgatgcgggggaagttcggcaagaagcacatgatcgccggggtgctgttcaccttcgtcctcctgctgagcggccagatcacctggcgcgacatggcccacacgctcatcatgatcggctccaacgccagcgaccggatggggatgggcgtgacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatgaccctcaagctgatcacccagttcgagacgtaccagctgtggaccgccctcgtctccctgacctgcagcaacaccatcttcacgctgaccgtggcctggcgcaccgccaccctcatcctggcgggggtctccctgctccccctgtgccagagctccagcatgcggaagacggactggctgccgatgaccgtggccgccatgggcgtgccgcccctccccctgttcatcttctccctgaaggacaccccgaagcgccgcagctggcccctcaacgagggggtcatggccgtgggcctggtgtccatcctggccagctccctcctgcggaacgacgtccccatggcgggccccctggtggccgggggcctcctgatcgcctgctacgtgatcaccgggacgagcgccgacctgaccgtcgagaaggccgcggacgtgacctgggaggaggaggccgagcagaccggcgtgtcccacaacctcatgatcacggtcgacgacgacgggaccatgaagatcaaggacgacgagaccgagaacatcctgaccgtgctgctcaagaccgccctgctgatcgtgagcggcatcttcccgtactccatccccgccacgctcctggtctggcacacctggcagaagcagacccagcgcagcggcgtgctgtgggacgtgcccagcccgcccgagacccagaaggccgagctcgaggagggggtctaccggatcaagcagcagggcatcttcgggaagacccaggtgggcgtgggggtccagaaggagggcgtgttccacaccatgtggcacgtgacccgcggcgcggtcctgacccacaacgggaagcggctggagcccaactgggccagcgtgaagaaggacctcatctcctacggcgggggctggcgcctgagcgcccagtggcagaagggggaggaggtgcaggtcatcgccgtggagcccggcaagaaccccaagaacttccagacgatgcccggcatcttccagaccaccaccggggagatcggcgcgatcgccctggacttcaagcccgggacgagcggctcccccatcatcaaccgggagggcaaggtggtcgggctgtacggcaacggggtggtgaccaagaacggcgggtacgtcagcggcatcgcccagaccaacgccgagccggacggccccacccccgagctcgaggaggagatgttcaagaagcgcaacctgacgatcatggacctgcaccccgggtccggcaagacccggaagtacctcccggccatcgtgcgcgaggcgatcaagcggcgcctgcggaccctgatcctcgcccccacccgcgtggtcgccgccgagatggaggaggccctgaaggggctgcccatccggtaccagacgaccgcgaccaagagcgagcacaccggccgcgagatcgtggacctcatgtgccacgccacgttcaccatgcggctgctgtcccccgtgcgcgtcccgaactacaacctcgtgatcatggacgaggcccacttcaccgaccccgccagcatcgccgcgcgggggtacatctccacccgcgtgggcatgggcgaggccgccgccatcttcatgacggcgacgccgcccgggaccgccgaggccttcccgcagagcaacgcccccatccaggacgaggagcgggacatccccgagcgctcctggaacagcggcaacgagtggatcaccgacttcgtcgggaagacggtgtggttcgtgccctccatcaaggccggcaacgacatcgcgaactgcctgcgcaagaacgggaagaaggtcatccagctgagccggaagaccttcgacaccgagtaccagaagacccgcctcaacgactgggacttcgtggtgacgaccgacatctccgagatgggcgccaacttcaaggccgaccgggtcatcgacccgcgccggtgcctgaagcccgtgatcctgaccgacggccccgagcgcgtgatcctcgccgggcccatgccggtcaccgccgcgagcgccgcccagcggcgcggccgggtggggcgcaacccccagaaggagaacgaccagtacatcttcatgggccagcccctgaacaacgacgaggaccacgcccactggacggaggccaagatgctgctcgacaacatcaacacccccgaggggatcatcccggcgctgttcgagcccgagcgggagaagtccgccgccatcgacggcgagtaccgcctgaagggcgagagccggaagaccttcgtcgagctcatgcgccgcggggacctgcccgtgtggctggcccacaaggtggcgtccgagggcatcaagtacaccgaccgcaagtggtgcttcgacggggagcggaacaaccagatcctcgaggagaacatggacgtcgagatctggaccaaggagggcgagcgcaagaagctgcggccccgctggctggacgcccgcacgtacagcgacccgctcgccctgaaggagttcaaggacttcgccgccggccggaagtccatcgcgctggacctcgtgaccgagatcgggcgcgtgcccagccacctggcccaccggacccgcaacgccctggacaacctcgtcatgctgcacaccagcgagcacggcgggcgggcctaccgccacgccgtggaggagctgcccgagacgatggagaccctcctgctgctcggcctgatgatcctgctcaccgggggcgcgatgctgttcctgatctccggcaaggggatcggcaagaccagcatcgggctcatctgcgtgatcgtctccagcggcatgctgtggatggccgacgtgccgctgcagtggatcgcctccgccatcgtgctcgagttcttcatgatggtcctgctgatccccgagcccgagaagcagcggacgccccaggacaaccagctcgcctacgtggtgatcgggatcctgaccctggcggccatcgtcgccgccaacgagatgggcctcctggagaccaccaagcgcgacctgggcatgagcaaggagccgggggtggtgtcccccacgagctacctcgacgtcgacctgcaccccgcctccgcgtggaccctgtacgccgtggccaccaccgtgatcacgcccatgctccggcacaccatcgagaacagcaccgccaacgtctccctggcggccatcgccaaccaggccgtggtgctgatgggcctcgacaaggggtggccgatcagcaagatggacctgggcgtccccctgctcgccctggggtgctactcccaggtgaaccccctgaccctcacggcggccgtgctgctgctcgtcacccactacgccatcatcggccccggcctgcaggccaaggccacccgcgaggcgcagaagcggaccgccgccgggatcatgaagaacccgacggtggacggcatcatgaccatcgacctggaccccgtgatctacgacagcaagttcgagaagcagctcgggcaggtcatgctgctggtgctctgcgccgtgcagctgctgctcatgcgcacctcctgggccctgtgcgaggcgctgaccctcgccacgggccccatcaccaccctgtgggagggcagccccgggaagttctggaacaccacgatcgccgtctccatggccaacatcttccggggcagctacctggcgggggccggcctcgccttctccatcatgaagtccgtggggaccggccgccggggcaccgggagccagggcgagaccctgggggagaagtggaagaagaagctgaaccagctctcccgcaaggagttcgacctgtacaagaagtccggcatcacggaggtggaccggaccgaggccaaggaggggctgaagcgcggcgagaccacccaccacgccgtctcccggggcagcgcgaagctccagtggttcgtggagcgcaacatggtgatcccggaggggcgggtcatcgacctgggctgcgggcgcggcgggtggtcctactactgcgccggcctgaagaaggtgaccgaggtgcgcggctacacgaagggcgggcccgggcacgaggagcccgtccccatgagcacctacggctggaacatcgtgaagctcatgtccgggaaggacgtgttctacctgccgcccgagaagtgcgacaccctgctgtgcgacatcggcgagagctcccccagccccaccgtcgaggagtcccggacgatccgcgtgctcaagatggtggagccgtggctgcggagcaaccagttctgcatcaaggtcctgaacccctacatgcccaccgtgatcgagtacctcgagcgcctgcagcggaagtacggcgggatgctggtgcgcaaccccctctcccggaacagcacccacgagatgtactggatctccaacggcaccgggaacatcgtcagctccgtgaacatggtcagccgcctgctgctcaaccggttcacgatgacccaccgccggccgaccatcgagaaggacgtggacctgggcgccggcacccgccacgtgaacgccgagcccgagacgcccaacatggacgtcatcggggagcggatcaagcgcatcaaggaggagcactccagcacctggcactacgacgacgagaacccgtacaagacctgggcctaccacggcagctacgaggtgaaggcgaccgggtccgccagctccatgatcaacggcgtggtcaagctgctcacgaagccctgggacgtggtgcccatggtcacccagatggccatgaccgacaccacgcccttcgggcagcagcgggtgttcaaggagaaggtggacacccgcaccccgcggcccatgcccggcacccgcaaggtcatggagatcacggccgagtggctgtggcggaccctgggccgcaacaagaagccccgcctctgcacccgggaggagttcaccaagaaggtgcgcacgaacgccgcgatgggggccgtgttcaccgaggagaaccagtgggacagcgcccgggccgcggtcgaggacgaggagttctggaagctggtggacaaggagcgcgagctgcacaagctcggcaagtgcgggtcctgcgtgtacaacatgatgggcaagcgggagaagaagctgggggagttcggcaaggccaagggcagccgcgccatctggtacatgtggctgggggcccggtacctcgagttcgaggccctgggcttcctgaacgaggaccactggttctcccgcgagaacagctactccggggtcgagggcgaggggctccacaagctgggctacatcctgcgggacatcagcaagatcccgggcggggcgatgtacgccgacgacaccgccggctgggacacccgcatcacggaggacgacctccacaacgaggagaagatcacccagcagatggaccccgagcaccggcagctggccaacgccatcttcaagctgacctaccagaacaaggtggtgaaggtccagcgccccacccccaaggggacggtgatggacatcatctcccggaaggaccagcgcggcagcggccaggtggggacctacggcctcaacaccttcaccaacatggaggcgcagctggtccggcagatggagggggagggcgtgctgtccaaggccgacctcgagaacccgcacctcctggagaagaagatcacccagtggctcgagacgaagggggtggagcgcctgaagcggatggccatcagcggcgacgactgcgtcgtgaagcccatcgacgaccgcttcgccaacgccctgctcgcgctgaacgacatgggcaaggtgcggaaggacatcccccagtggcagccctccaaggggtggcacgactggcagcaggtcccgttctgcagccaccacttccacgagctgatcatgaaggacggccgcaagctcgtggtgccctgccggccccaggacgagctgatcgggcgcgcccgcatctcccagggcgccgggtggagcctgaaggagaccgcctgcctcggcaaggcctacgcgcagatgtggtccctgatgtacttccaccggcgcgacctgcggctcgccagcaacgccatctgcagcgccgtccccgtgcactggatcccgacctcccgcaccacgtggagcatccacgcgcaccaccagtggatgaccaccgaggacatgctgaccgtgtggaaccgggtctggatcgaggacaacccctggatggaggacaagacgcccgtgaccacctgggaggacgtgccctacctgggcaagcgcgaggaccagtggtgcgggtccctcatcggcctgaccagccgggccacgtgggcccagaacatcctgaccgccatccagcaggtccgctccctcatcggggacgaggagttcctggactacatgccgagcatgaagcggttccgcaaggaggaggagaccgagggcgccatctggtga

SEQ ID NO: 9952 - RNA, 9873 nt, synthetic construct
  misc_feature 1..9873: note = derived and/or modified CDS sequence (opt1) from DENV-3__GU131946__SS-prME
  source 1..9873: mol_type = other RNA
accagcctgtgcctcatgatgatgctgcccgccaccctggccttccacctcaccagccgggacggggagccccggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcgggatcctgaactccctcggcaagatggtgcaccagatcttcgggagcgcgtacaccgccctgttctccggcgtgagctggatcatgaagatcggcatcggggtcctgctcacgtggatcggcctgaactccaagaacaccagcatgtccttcagctgcatcgtgatcgggatcatcaccctgtacctcggcgccgtggtccaggccgacatggggtgcgtgatcaactggaagggcaaggagctgaagtgcggctccgggatcttcgtgaccaacgaggtccacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggcgcggatcgtcaccgccgagacccagaactccagcttcatcatcgacggccccaacacccccgagtgcccctccgccagccgcgcctggaacgtgtgggaggtggaggactacgggttcggcgtcttcacgaccaacatctggctgaagctccgggaggtgtacacccagagctgcgaccaccgcctgatgtccgcggccatcaaggacgagcgggccgtgcacgccgacatgggctactggatcgagagccagaagaacgggtcctggaagctggagaaggccagcttcatcgaggtcaagacctgcacctggccgaagtcccacacgctctggagcaacggcgtgctggagtccgacatgatcatccccaagagcctggcggggcccatctcccagcacaaccaccgcccgggctaccacacccagaccgccgggccctggcacctcggcaagctggagctggacttcaactactgcgagggcaccacggtggtcatcaccgagaactgcgggacccggggccccagcctccgcaccacgaccgtgtccgggaagctgatccacgagtggtgctgccggagctgcaccctgcccccgctccgctacatgggcgaggacgggtgctggtacggcatggagatccggcccatcaacgagaaggaggagaacatggtgaagtccctggtcagcgccggctccgggaaggtggacaacttcaccatgggcgtgctgtgcctcgccatcctgttcgaggaggtcatgcgcgggaagttcggcaagaagcacatgatcgccggggtgctgttcacgttcgtgctcctgctgagcggccagatcacctggcgggacatggcgcacaccctcatcatgatcggctccaacgccagcgaccgcatggggatgggcgtcacctacctggccctgatcgccacgttcaagatccagcccttcctcgccctggggttcttcctgcggaagctcaccagccgcgagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtgtccctgacgtgcagcaacaccatcttcaccctgaccgtcgcctggcggacggccaccctcatcctggccggggtgtccctgctcccgctgtgccagagctccagcatgcgcaagaccgactggctgcccatgaccgtcgccgcgatgggcgtgccgcccctgccgctgttcatcttctccctgaaggacacgcccaagcgccggagctggcccctcaacgagggggtgatggccgtcggcctggtgtccatcctggccagctccctcctgcgcaacgacgtgcccatggccggcccgctggtcgccgggggcctcctgatcgcgtgctacgtgatcaccgggaccagcgccgacctgaccgtggagaaggccgccgacgtcacgtgggaggaggaggccgagcagaccggcgtgtcccacaacctcatgatcaccgtggacgacgacgggaccatgcggatcaaggacgacgagaccgagaacatcctgacggtcctgctcaagaccgcgctgctgatcgtgagcggcatcttcccctactccatccccgccaccctcctggtgtggcacacctggcagaagcagacgcagcgcagcggcgtcctgtgggacgtgccctccccgcccgagacccagaaggccgagctcgaggagggggtgtaccggatcaagcagcagggcatcttcgggaagacccaggtcggcgtgggggtgcagaaggagggcgtcttccacaccatgtggcacgtgacgcgcggcgccgtgctgacccacaacgggaagcggctggagcccaactgggccagcgtcaagaaggacctcatctcctacggcgggggctggcgcctgagcgcgcagtggcagaagggggaggaggtccaggtgatcgccgtcgagcccggcaagaacccgaagaacttccagaccatgcccggcatcttccagaccacgaccggggagatcggcgccatcgccctggacttcaagcccgggaccagcggctccccgatcatcaaccgggagggcaaggtggtggggctgtacggcaacggggtcgtgaccaagaacggcgggtacgtgagcggcatcgcgcagacgaacgccgagcccgacggccccacccccgagctcgaggaggagatgttcaagaagcgcaacctgaccatcatggacctgcacccggggtccggcaagacccggaagtacctccccgccatcgtccgcgaggccatcaagcggcgcctgcggacgctgatcctcgcccccacccgcgtggtggcggccgagatggaggaggccctgaaggggctgcccatccggtaccagaccaccgccaccaagagcgagcacaccggccgcgagatcgtcgacctcatgtgccacgccaccttcaccatgcggctgctgtccccggtgcgcgtgcccaactacaacctcgtcatcatggacgaggcgcacttcacggaccccgccagcatcgccgcccgggggtacatctccacccgcgtgggcatgggcgaggccgcggccatcttcatgaccgccacgccgcccgggacggccgaggcgttcccccagagcaacgcccccatccaggacgaggagcgcgacatccccgagcggtcctggaacagcggcaacgagtggatcaccgacttcgtggggaagaccgtctggttcgtgccctccatcaaggccggcaacgacatcgccaactgcctgcgcaagaacgggaagaaggtgatccagctgagccggaagaccttcgacacggagtaccagaagacccgcctcaacgactgggacttcgtcgtgaccaccgacatctccgagatgggcgccaacttcaaggcggaccgggtgatcgacccccgccggtgcctgaagcccgtcatcctgacggacggccccgagcgcgtgatcctcgccgggccgatgcccgtgaccgccgccagcgccgcgcagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagagccggaagacgttcctcgagctgatgcgccgcggggacctgcccgtgtggctcgcccacaaggtcgcctccgagggcatcaagtacaccgaccgcaagtggtgcttcgacggggagcggaacaaccagatcctggaggagaacatggacgtggagatctggaccaaggagggcgagcgcaagaagctgcgcccgcggtggctcgacgcccgcacctacagcgaccccctggcgctgaaggagttcaaggacttcgccgccggccggaagtccatcgccctcgacctggtgacggagatcgggcgcgtccccagccacctggcccaccggacccgcagcgcgctcgacaacctggtgatgctgcacacctccgagcacggcgggcgggcctaccgccacgccgtggaggagctcccggagaccatggagacgctgctgctcctgggcctgatgatcctcctgaccgggggcgccatgctgttcctcatcagcggcaaggggatcggcaagacctccatcgggctgatctgcgtcatcgtgagctccggcatgctgtggatggccgacgtgcccctccagtggatcgcgagcgccatcgtcctggagttcttcatgatggtgctgctcatccccgagcccgagaagcagcggaccccgcaggacaaccagctggcctacgtggtcatcgggatcctgacgctcgccgccatcgtggcggccaacgagatgggcctgctggagaccaccaagcgcgacctcggcatgtccaaggagcccggggtggtcagccccacctcctacctggacgtggacctgcaccccgccagcgcctggacgctctacgccgtggcgaccaccgtcatcaccccgatgctgcggcacacgatcgagaactccaccgccaacgtgagcctggccgccatcgcgaaccaggccgtggtcctcatgggcctggacaaggggtggcccatctccaagatggacctgggcgtgcccctcctggccctggggtgctacagccaggtgaaccccctcaccctgaccgccgccgtcctgctcctggtgacgcactacgcgatcatcggcccgggcctgcaggccaaggccacccgcgaggcccagaagcggaccgccgcggggatcatgaagaaccccaccgtggacggcatcatgacgatcgacctcgaccccgtcatctacgactccaagttcgagaagcagctgggccaggtgatgctgctcgtgctgtgcgccgtccagctgctcctgatgcgcaccagctgggccctgtgcgaggccctcaccctggccaccggccccatcacgaccctgtgggagggctccccggggaagttctggaacaccaccatcgcggtgagcatggccaacatcttccggggctcctacctcgccggggccggcctggcgttcagcatcatgaagtccgtggggacgggccgccggggcaccgggtcccagggcgagaccctgggggagaagtggaagaagaagctcaaccagctgagccgcaaggagttcgacctgtacaagaagtccggcatcaccgaggtcgaccggaccgaggccaaggaggggctcaagcgcggcgagacgacccaccacgccgtgagccggggctccgccaagctgcagtggttcgtggagcgcaacatggtcatccccgaggggcgcgtgatcgacctgggctgcgggcggggcgggtggagctactactgcgccggcctcaagaaggtgaccgaggtccgcggctacaccaagggcgggcccgggcacgaggagcccgtgccgatgtccacgtacggctggaacatcgtgaagctgatgagcgggaaggacgtcttctacctgccgcccgagaagtgcgacaccctgctctgcgacatcggcgagtccagcccctccccgaccgtggaggagagccggaccatccgcgtgctgaagatggtcgagccctggctgcggaacaaccagttctgcatcaaggtgctcaacccctacatgcccacggtgatcgagcacctggagcgcctgcagcggaagtacggcgggatgctcgtccgcaacccgctgtcccggaacagcacccacgagatgtactggatctccaacggcaccgggaacatcgtgagctccgtgaacatggtcagccgcctgctcctgaaccggttcaccatgacgcaccgccggcccaccatcgagaaggacgtggacctgggcgcgggcacccgccacgtcaacgccgagcccgagaccccgaacatggacgtgatcggggagcggatcaagcgcatcaaggaggagcactccagcacgtggcactacgacgacgagaacccctacaagacctgggcctaccacggcagctacgaggtgaaggccaccgggtccgccagctccatgatcaacggcgtcgtgaagctcctgaccaagccctgggacgtggtccccatggtgacgcagatggcgatgaccgacaccaccccgttcgggcagcagcgggtgttcaaggagaaggtcgacacgcgcacgccccggcccatgcccggcacccgcaaggtgatggagatcaccgccgagtggctgtggcgcacgctcggccggaacaagaagccgcgcctgtgcacccgggaggagttcaccaagaaggtgcgcaccaacgccgccatgggggccgtcttcacggaggagaaccagtgggacaacgcgcgggccgccgtggaggacgaggagttctggaagctggtggaccgcgagcgggagctccacaagctgggcaagtgcgggagctgcatctacaacatgatgggcaagcgcgagaagaagctgggggagttcggcaaggccaagggctcccgggcgatctggtacatgtggctcggggcccgctacctggagttcgaggccctgggcttcctcaacgaggaccactggttcagccgggagaactcctacagcggggtcgagggcgaggggctgcacaagctgggctacatcctccgcgacatctccaagatccccggcggggccatgtacgccgacgacaccgcgggctgggacacccggatcaccgaggacgacctgcacaacgaggagaagatcacgcagcagatggaccccgagcaccgccagctggccaacgccatcttcaagctcacctaccagaacaaggtggtgaaggtccagcggcccaccccgaaggggaccgtgatggacatcatcagccgcaaggaccagcggggctccggccaggtggggacctacggcctgaacacgttcaccaacatggaggcccagctggtccgccagatggagggggagggcgtgctcagcaaggccgacctggagaacccccacctcctcgagaagaagatcacccagtggctggagaccaagggggtggaccggctgaagcgcatggcgatctccggcgacgactgcgtcgtgaagcccatcgacgaccggttcgccaacgccctcctggccctgaacgacatgggcaaggtgcgcaaggacatcccccagtggcagccgagcaaggggtggcacgactggcagcaggtccccttctgctcccaccacttccacgagctcatcatgaaggacggccgcaagctggtggtgccctgccggccccaggacgagctgatcgggcgcgcccggatcagccagggcgcggggtggtccctcaaggagacggcctgcctgggcaaggcctacgcccagatgtggagcctgatgtacttccaccgccgggacctccgcctggcctccaacgcgatctgcagcgccgtcccggtgcactggatccccaccagccggaccacctggtccatccacgcccaccaccagtggatgacgaccgaggacatgctgaccgtgtggaaccgcgtctggatcgaggacaacccctggatggaggacaagacccccgtgacgacctgggaggacgtgccgtacctcggcaagcgggaggaccagtggtgcgggagcctgatcggcctgacctcccgcgccacctgggcgcagaacatcctcacggccatccagcaggtccggagcctgatcggggacgaggagttcctggactacatgccctccatgaagcgcttccggaaggaggaggagagcgagggcgccatctggtga

SEQ ID NO: 9953 - RNA, 9873 nt, synthetic construct
  misc_feature 1..9873: note = derived and/or modified CDS sequence (opt1) from DENV-3__FJ639712__SS-prME
  source 1..9873: mol_type = other RNA
accagcctctgcctcatgatgatgttccccgccaccctggccttccacctgacgagccgcgacggcgagccgcggatgatcgtggggaagaacgagcgcggcaagagcctcctgttcaagaccgcgagcgggatcaacatgtgcaccctgatcgccatggacctcggcgagatgtgcgacgacaccgtgacctacaagtgccccctgatcgccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagagcaagcccaccctcgacatcgagctgcagaagaccgaggccacccagctggcgacgctccggaagctgtgcatcgagggcaagatcaccaacatcaccaccgactcccgctgccccacgcagggcgaggccaccctgccggaggagcaggaccagaactacgtgtgcaagcacacctacgtcgaccgggggtggggcaacgggtgcggcctcttcgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgacacccagggggtgacggtcgagatcacgccccaggcctccaccgtggaggccgtgctgcccgagtacggcaccctggggctcgagtgcagcccgcgcaccggcctggacttcaacgagatgatcctgctcacgatgaagaacaaggcgtggatggtccaccggcagtggttcttcgacctgcccctgccctggacctccggcgccaccaccgagacgcccacctggaaccgcaaggagctcctggtgaccttcaagaacgcccacgccaagaagcaggaggtggtcgtgctggggagccaggagggcgccatgcacaccgcgctcacgggggccaccgagatccagaactccggcgggaccagcatcttcgccggccacctgaagtgccggctgaagatggacaagctcgagctgaagggcatgtcctacgccatgtgcctgaacaccttcgtgctcaagaaggaggtcagcgagacgcagcacgggaccatcctgatcaaggtggagtacaagggcgaggacgccccgtgcaagatccccttcagcaccgaggacgggcagggcaaggcgcactccggccgcctgatcaccgccaaccccgtggtcacgaagaaggaggagcccgtgaacatcgaggccgagccgcccttcggggagagcaacatcgtgatcggcatcggggacaaggccctgaagatcaactggtacaagaagggctccagcatcgggaagatgttcgaggcgaccgcccggggcgcccgccggatggccatcctcggcgacaccgcctgggacttcgggtccgtcggcggggtgctgaacagcctgggcaagatggtgcaccagatcttcgggtccgcgtacaccgccctcttcagcggcgtctcctgggtgatgaagatcggcatcggggtgctgctgacgtggatcggcctcaacagcaagaacacctccatgagcttctcctgcatcgtcatcgggatcatcaccctgtacctgggcgccgtggtgcaggccgacatggggtgcgtcatcaactggaagggcaaggagctcaagtgcggcagcgggatcttcgtgaccaacgaggtgcacacgtggaccgagcagtacaagttccaggccgactcccccaagcgcctggcgaccgccatcgccggcgcctgggagaacggggtctgcggcatccgcagcaccacgcggatggagaacctgctctggaagcagatcgccaacgagctgaactacatcctgtgggagaacaacatcaagctcaccgtggtggtcggggacatcatcggcgtgctggagcagggcaagcgcaccctgacgccccagccgatggagctcaagtactcctggaagacgtgggggaaggcgaagatcgtgaccgccgagacccagaacagctccttcatcatcgacggccccaacacccccgagtgccccagcgccagccgggcctggaacgtctgggaggtggaggactacgggttcggcgtgttcacgaccaacatctggctgaagctgcgcgaggtctacacccagtcctgcgaccaccggctcatgagcgcggccatcaaggacgagcgcgccgtgcacgccgacatgggctactggatcgagtcccagaagaacgggagctggaagctggagaaggcctccttcatcgaggtgaagacctgcacctggcccaagagccacacgctgtggtccaacggcgtcctcgagagcgacatgatcatccccaagtccctggcggggcccatcagccagcacaaccaccggccgggctaccacacccagaccgccgggccctggcacctgggcaagctcgagctggacttcaactactgcgagggcaccacggtggtgatcaccgagaactgcgggacccgcggcccctccctgcggaccacgaccgtcagcgggaagctcatccacgagtggtgctgccgctcctgcaccctgcccccgctgcggtacatgggcgaggacgggtgctggtacggcatggagatccgccccatcaacgagaaggaggagaacatggtcaagagcctcgtgtccgccggcagcgggaaggtcgacaacttcaccatgggcgtgctgtgcctggccatcctcttcgaggaggtgatgcgggggaagttcggcaagaagcacatgatcgccggggtcctgttcacgttcgtgctgctcctgtccggccagatcacctggcgcgacatggcgcacaccctgatcatgatcggcagcaacgccagcgaccggatggggatgggcgtgacctacctcgccctgatcgccacgttcaagatccagcccttcctggccctcgggttcttcctgcgcaagctgacctcccgggagaacctcctgctgggcgtcggcctcgcgatggccaccaccctgcagctgcccgaggacatcgagcagatggccaacgggatcgccctcggcctgatgacgctgaagctcatcacccagttcgagacctaccagctgtggaccgcgctggtgagcctcacgtgctccaacaccatcttcaccctgaccgtcgcctggcgcacggccaccctgatcctcgccggggtgagcctgctgccgctctgccagtccagctccatgcggaagaccgactggctgcccatgaccgtggccgcgatgggcgtgccgcccctccccctcttcatcttcagcctgaaggacacgcccaagcgccgctcctggcccctgaacgagggggtgatggccgtgggcctcgtcagcatcctggcctccagcctgctccggaacgacgtgcccatggccggcccgctggtggccgggggcctgctcatcgcgtgctacgtcatcaccgggacctccgccgacctgaccgtggagaaggccgccgacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgcgctcctgatcgtctccggcatcttcccctacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacccacaacgggaagcgcctggagcccaactgggcctccgtgaagaaggacctgatcagctacggcgggggctggcggctcaacgcgcagtggcagaagggggaggaggtccaggtgatcgccgtggagcccggcaagaacccgaagaacttccagaccatgcccggcatcttccagaccacgaccggggagatcggcgccatcgccctggacttcaagcccgggaccagcggctccccgatcatcaaccgcgagggcaaggtcgtggggctgtacggcaacggggtggtcaccaagaacggcgggtacgtgagcggcatcgcgcagacgaacgccgagcccgacggccccacccccgagctggaggaggagatgttcaagaagcggaacctcaccatcatggacctgcacccggggtccggcaagacccgcaagtacctgcccgccatcgtgcgggaggccatcaagcgccggctccgcacgctgatcctggcccccacccgggtcgtggcggccgagatggaggaggccctcaaggggctgcccatccgctaccagaccaccgccaccaagagcgagcacaccggccgggagatcgtggacctgatgtgccacgccaccttcaccatgcgcctcctgtccccggtccgggtgcccaactacaacctggtgatcatggacgaggcgcacttcacggaccccgccagcatcgccgcccgcgggtacatctccacccgggtcggcatgggcgaggccgcggccatcttcatgaccgccacgcccccggggacggccgaggcgttcccccagagcaacgcccccatccaggacgaggagcgcgacatccccgagcgctcctggaacagcggcaacgagtggatcaccgacttcgtggggaagaccgtgtggttcgtcccgtccatcaaggccggcaacgacatcgccaactgcctccggaagaacgggaagaaggtgatccagctgagccgcaagaccttcgacacggagtaccagaagacccggctgaacgagtgggacttcgtggtcaccaccgacatctccgagatgggcgccaacttcaaggcggaccgcgtgatcgacccccggcgctgcctcaagcccgtgatcctgacggacggccccgagcgggtcatcctggccgggccgatgcccgtgaccgccgccagcgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgcgagaagtccgccgcgatcgacggcgagtaccggctgaagggcgagagccgcaagacgttcgtggagctgatgcggcgcggggacctccccgtgtggctggcccacaaggtcgcctccgagggcatcaagtacgccgaccggaagtggtgcttcgacggggagcgcaacaaccagatcctggaggagaacatggacgtggagatctggaccaaggagggcgagcggaagaagctccgcccgcgctggctggacgcgcggacctacagcgaccccctggccctcaaggagttcaaggacttcgccgccggccgcaagtccatcgccctggacctggtgaccgagatcgggcgggtccccagccacctcgcgcaccgcacgcggaacgccctggacaacctggtgatgctccacaccagcgagcacggcgggcgcgcctaccggcacgccgtggaggagctgccggagaccatggagaccctgctcctgctgggcctcatgatcctgctgaccggcggggccatgctgttcctgatctccgggaaggggatcggcaagaccagcatcgggctgatctgcgtcatcgtgtccagcggcatgctctggatggcggacgtgcccctgcagtggatcgcctccgccatcgtcctggagttcttcatgatggtgctcctgatccccgagcccgagaagcagcgcaccccgcaggacaaccagctggcctacgtggtcatcgggatcctcaccctggccgcgatcgtggccgccaacgagatgggcctgctcgagacgaccaagcgggacctgggcatgagcaaggagcccggggtggtctcccccaccagctacctggacgtggacctccaccccgcctccgcctggaccctgtacgcggtggccacgaccgtcatcaccccgatgctgcgccacaccatcgagaacagcacggccaacgtgtccctcgccgcgatcgccaaccaggccgtggtcctgatgggcctggacaaggggtggcccatcagcaagatggacctcggcgtgcccctgctggccctcgggtgctactcccaggtgaaccccctgaccctgaccgccgcggtcctcctgctggtgacccactacgccatcatcggcccgggcctccaggccaaggccacgcgggaggcccagaagcgcaccgcggccgggatcatgaagaaccccaccgtggacggcatcatgaccatcgacctggaccccgtcatctacgacagcaagttcgagaagcagctgggccaggtgatgctcctggtgctgtgcgccgtccagctcctgctgatgcggacgtcctgggccctctgcgaggccctgaccctggcgaccggccccatcaccacgctctgggagggcagcccggggaagttctggaacaccaccatcgccgtgtccatggccaacatcttccgcggcagctacctggccggggcgggcctggccttctccatcatgaagtccgtggggaccggccggcgcggcacggggagccagggcgagaccctcggggagaagtggaagaagaagctgaaccagctgtcccggaaggagttcgacctctacaagaagtccggcatcaccgaggtcgaccgcaccgaggccaaggaggggctgaagcggggcgagaccacgcaccacgccgtgtcccgcggcagcgccaagctgcagtggttcgtggagcggaacatggtcatccccgaggggcgcgtgatcgacctcggctgcgggcgcggcgggtggtcctactactgcgcgggcctgaagaaggtgaccgaggtccggggctacaccaagggcgggcccgggcacgaggagcccgtgccgatgagcacctacggctggaacatcgtgaagctgatgtccgggaaggacgtcttctacctgccgcccgagaagtgcgacacgctgctgtgcgacatcggcgagagctcccccagcccgaccgtggaggagtcccgcaccatccgggtgctgaagatggtcgagccctggctccgcaacaaccagttctgcatcaaggtgctgaacccctacatgcccaccgtgatcgagcacctggagcggctccagcgcaagtacggcgggatgctggtccggaacccgctgagccgcaactccacgcacgagatgtactggatcagcaacggcaccgggaacatcgtgtccagcgtcaacatggtgtcccggctcctgctgaaccgcttcaccatgacccaccggcgccccacgatcgagaaggacgtggacctcggcgccggcacccggcacgtcaacgccgagcccgagaccccgaacatggacgtgatcggggagcgcatcaagcggatcaaggaggagcacagctccacctggcactacgacgacgagaacccctacaagacgtgggcctaccacggcagctacgaggtgaaggccaccgggagcgcgtccagcatgatcaacggcgtcgtgaagctgctgaccaagccctgggacgtggtccccatggtgacccagatggccatgacggacaccaccccgttcgggcagcagcgcgtgttcaaggagaaggtcgacacccggacgccccgccccatgcccggcacccggaaggtgatggagatcaccgccgagtggctctggcgcaccctgggccgcaacaagaagccgcggctgtgcacgcgcgaggagttcaccaagaaggtgcggaccaacgccgccatgggggcggtcttcaccgaggagaaccagtgggactccgcccgcgccgccgtggaggacgaggagttctggaagctcgtggaccgggagcgcgagctgcacaagctgggcaagtgcgggagctgcgtctacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgcggacgacacggccggctgggacacccgcatcaccgaggacgacctgcacaacgaggagaagatcacccagcagatggaccccgagcaccggcagctcgccaacgccatcttcaagctgacgtaccagaacaaggtggtcaaggtgcagcgccccaccccgaaggggaccgtgatggacatcatcagccggaaggaccagcgcggctccggccaggtcgggacctacggcctgaacaccttcacgaacatggaggcccagctcgtgcggcagatggagggggagggcgtgctgagcaaggcggacctggagaacccccacctcctggagaagaagatcacccagtggctggagaccaagggggtcgagcgcctcaagcggatggccatctccggcgacgactgcgtggtgaagcccatcgacgaccgcttcgccaacgccctgctggccctcaacgacatgggcaaggtccggaaggacatcccccagtggcagccgagcaaggggtggcacgactggcagcaggtccccttctgctcccaccacttccacgagctgatcatgaaggacggccgcaagctggtggtcccctgccgcccccaggacgagctcatcgggcgggcgcgcatcagccagggcgccgggtggtccctgaaggagaccgcctgcctgggcaaggcctacgcccagatgtggagcctcatgtacttccaccggcgcgacctgcggctggcgtccaacgccatctgcagcgccgtgccggtgcactggatccccacgagccgcaccacctggtccatccacgcccaccaccagtggatgaccacggaggacatgctcaccgtctggaaccgggtgtggatcgaggacaacccctggatggaggacaagacccccgtgaccacgtgggaggacgtcccgtacctgggcaagcgcgaggaccagtggtgcgggagcctgatcggcctcacctcccgggcgacctgggcccagaacatcctgaccgccatccagcaggtccgcagcctgatcggggacgaggagttcctcgactacatgccctccatgaagcggttccgcaaggaggaggagagcgagggcgccatctggtga

SEQ ID NO: 9954 - RNA, 9873 nt, synthetic construct
  misc_feature 1..9873: note = derived and/or modified CDS sequence (opt1) from DENV-3__FJ639713__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgcctcccgggcctggaacgtgtgggaggtcgaggactacgggttcggcgtgttcacgaccaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtcgtgatcgccgagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcaccttcgtcctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccggcgggctcctgatcgcctgctacgtgatcacggggacctccgccgacctgaccgtcgagaaggccgccgacgtgacctgggaggaggaggcggagcagacgggggtgagccacaacctcatgatcaccgtcgacgacgacgggaccatgcgcatcaaggacgacgagaccgagaacatcctgaccgtgctgctcaagacggccctgctgatcgtgtccggcatcttcccctacagcatccccgccaccctcctggtctggcacacctggcagaagcagacccagcggtccggcgtgctgtgggacgtgcccagcccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggcgtccgtgaagaaggacctcatcagctacggcgggggctggcggctgtccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtcgggctgtacggcaacggggtggtgaccaagaacggcgggtacgtctccggcatcgcccagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcgcccacgcgggtggtcgccgccgagatggaggaggccctgaaggggctgcccatccgctaccagaccaccgccaccaagtccgagcacacgggccgggagatcgtggacctcatgtgccacgcgaccttcaccatgcgcctgctgagcccggtgcgggtccccaactacaacctcgtgatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgcgaacttcaaggccgaccgcgtcatcgacccccggcgctgcctgaagcccgtgatcctgaccgacggccccgagcgggtgatcctcgccgggccgatgcccgtcacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgcaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcagcgaggccaaggaggggctgaagcggggcgagaccacccaccacgccgtctcccgcggcagcgccaagctccagtggttcgtggagcggaacatggtgatccccgaggggcgcgtcatcgacctgggctgcgggcgcggcgggtggtcctactactgcgcgggcctgaagaaggtgacggaggtgcggggctacaccaagggcggccccgggcacgaggagcccgtcccgatgagcacctacggctggaacatcgtgaagctcatgtccgggaaggacgtgttctacctgccgcccgagaagtgcgacaccctgctgtgcgacatcggcgagagctcccccagcccgacggtcgaggagtcccgcaccatccgggtgctcaagatggtggagccctggctgcgcaacaaccagttctgcatcaaggtcctgaacccctacatgcccaccgtgatcgagcacctcgagcggctgcagcgcaagcacggcgggatgctggtgcggaacccgctcagccgcaactccacccacgagatgtactggatcagcaacggcacggggaacatcgtctccagcgtgaacatggtctcccggctgctgctcaaccgcttcaccatgacccaccggcgccccaccatcgagaaggacgtggacctgggcgccggcacgcggcacgtgaacgccgagcccgagaccccgaacatggacgtcatcggggagcgcatcaagcggatcaaggaggagcacagctccacctggcactacgacgacgagaacccctacaagacctgggcctaccacggcagctacgaggtgaaggccacggggagcgcgtccagcatgatcaacggcgtggtcaagctgctcaccaagccctgggacgtggtgcccatggtcacccagatggccatgaccgacacgaccccgttcgggcagcagcgcgtgttcaaggagaaggtggacacccggacgccccggcccatgcccggcacgcggaaggtcatggagatcaccgccgagtggctgtggcgcaccctgggccgcaacaagaagccgcggctctgcacccgcgaggagttcacgaagaaggtgcggaccaacgccgccatgggggcggtgttcaccgaggagaaccagtgggactccgcccgcgccgccgtcgaggacgaggagttctggaagctggtggacaaggagcgggagctgcacaagctcggcaagtgcgggagctgcgtgtacaacatgatgggcaagcgcgagaagaagctgggggagttcggcaaggcgaagggctcccgggccatctggtacatgtggctgggggcccgctacctcgagttcgaggccctgggcttcctgaacgaggaccactggttcagccgggagaactcctacagcggggtcgagggcgaggggctccacaagctgggctacatcctgcgcgacatctccaagatccccggcggggccatgtacgcggacgacaccgccggctgggacacgcggatcaccgaggacgacctccacaacgaggagaagatcacccagcagatggaccccgagcaccgccagctggccaacgccatcttcaagctgacctaccagaacaaggtggtgaaggtccagcggcccacgccgaaggggaccgtgatggacatcatcagccgcaaggaccagcggggctccggccaggtggggacctacggcctcaacaccttcaccaacatggaggcccagctggtccgccagatggagggggagggcgtgctgagcaaggcggacctcgagaacccccacctcctggagaagaagatcatccagtggctcgagacgaagggggtggagcggctgaagcgcatggccatctccggcgacgactgcgtcgtgaagcccatcgacgaccggttcgccaacgccctgctcgccctgaacgacatgggcaaggtgcgcaaggacatcccccagtggcagccgagcaaggggtggcacgactggcagcaggtccccttctgctcccaccacttccacgagctgatcatgaaggacggccggaagctcgtggtgccctgccgcccccaggacgagctgatcgggcgcgcgcggatcagccagggcgccgggtggtccctgaaggagaccgcctgcctcggcaaggcctacgcccagatgtggagcctgatgtacttccaccgccgggacctgcgcctcgcgtccaacgccatctgcagcgccgtcccggtgcactggatccccaccagccggaccacgtggtccatccacgcccaccaccagtggatgaccaccgaggacatgctgagcgtgtggaaccgcgtctggatcgaggacaacccctggatggaggacaagacccccgtgacgacctgggaggacgtgccgtacctgggcaagcgggaggaccagtggtgcgggtccctcatcggcctgaccagccgcgcgacctgggcccagaacatcctgacggccatccagcaggtccggtccctcatcggggacgaggagttcctggactacatgcccagcatgaagcgcttccggaaggaggaggagtccgagggcgccatctggtga

SEQ ID NO: 9955 - RNA, 9873 nt, synthetic construct
  misc_feature 1..9873: note = derived and/or modified CDS sequence (opt1) from DENV-3__FJ639714__SS-prME
  source 1..9873: mol_type = other RNA
accagcctgtgcctcatgatgatgctgcccgcgaccctggccttccacctcaccagccgggacggcgagccccggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgactcccccaagcgcctggcgaccgccatcgccggcgcctgggagagcggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggcgaagatcgtgaccgccgagacccagaactccagcttcatcatcgacggccccaacacccccgagtgcccctccgccagccgggcctggaacgtgtgggaggtcgaggactacgggttcggcgtgttcacgaccaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcaccacggtcgtgatcgccgagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgcgggggtgctgttcaccttcgtcctcctgctgagcggccagatcacgtggcgcgacatggcccacaccctcatcatgatcggctccaacgccagcgaccggatggggatgggcgtgacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtctccctgacctgcagcaacacgatcttcaccctgaccgtggcctggcgcaccgccacgctcatcctggccggggtctccctgctcccgctgtgccagagctccagcatgcggaagaccgactggctgcccatgaccgtggcggccatgggcgtgccgcccctgccgctgttcatcttctccctgaaggacacccccaagcgccgcagctggcccctcaacgagggggtcatggccgtgggcctggtgtccatcctggccagctccctcctgcggaacgacgtccccatggccggcccgctggtggccggcgggctcctgatcgcctgctacgtgatcacggggaccagcgccgacctgaccgtcgagaaggccgccgacgtgacctgggaggaggaggcggagcagacgggggtgtcccacaacctcatgatcaccgtcgacgacgacgggaccatgcgcatcaaggacgacgagaccgagaacatcctgaccgtgctgctcaagacggccctgctgatcgtgagcggcatcttcccctactccatccccgccaccctcctggtctggcacacctggcagaagcagacccagcggagcggcgtgctgtgggacgtgccctccccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggcgagcgtgaagaaggacctcatctcctacggcgggggctggcggctgagcgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggctccccgatcatcaaccgcgagggcaaggtggtcgggctgtacggcaacggggtggtgaccaagaacggcgggtacgtcagcggcatcgcccagaccaacgccgagcccgacggccccacgcccgagctcgaggaggagatgttcaagaagcggaacctgaccatcatggacctgcacccggggtccggcaagacccgcaagtacctccccgccatcgtgcgggaggccatcaagcgccggctgcgcaccctgatcctcgcgcccacgcgggtggtcgccgccgagatggaggaggccctgaaggggctgcccatccgctaccagaccaccgccaccaagagcgagcacacgggccgggagatcgtggacctcatgtgccacgcgaccttcaccatgcgcctgctgtccccggtgcgggtccccaactacaacctcgtgatcatggacgaggcccacttcaccgaccccgccagcatcgccgcccgcgggtacatctccacgcgggtgggcatgggcgaggcggccgccatcttcatgaccgccacgccgcccgggaccgcggaggccttcccccagagcaacgcccccatccaggacgaggagcgcgacatccccgagcgctcctggaacagcggcaacgagtggatcacggacttcgtcgggaagaccgtgtggttcgtgccctccatcaaggccggcaacgacatcgccaactgcctgcggaagaacgggaagaaggtcatccagctgagccgcaagaccttcgacaccgagtaccagaagacgcggctcaacgactgggacttcgtggtgaccaccgacatctccgagatgggcgcgaacttcaaggccgaccgcgtcatcgacccccggcgctgcctgaagcccgtgatcctgaccgacggccccgagcgggtgatcctcgccgggccgatgcccgtcacggccgccagcgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagagccgcaagaccttcgtcgagctcatgcggcgcggggacctgcccgtgtggctggcccacaaggtggcctccgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctacagcgaccccctcgccctgaaggagttcaaggacttcgccgccggccgcaagtccatcgccctggacctcgtgaccgagatcgggcgggtgcccagccacctggcgcaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccggcggggccatgctgttcctgatctccgggaaggggatcggcaagaccagcatcgggctcatctgcgtgatcgtctccagcggcatgctgtggatggcggacgtgcccctgcagtggatcgcctccgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgagcaaggagcccggggtggtgtcccccaccagctacctcgacgtcgacctgcaccccgcctccgcctggaccctgtacgcggtggccacgaccatcatcaccccgatgctccgccacaccatcgagaacagcacggccaacgtgtccctggccgcgatcgccaaccaggccgtcgtgctgatgggcctcgacaaggggtggcccatcagcaagatggacctgggcgtgcccctgctcgccctggggtgctactcccaggtcaaccccctgaccctcaccgccgcggtgctgctgctcgtgacccactacgccatcatcggcccgggcctgcaggccaaggccacgcgggaggcccagaagcgcaccgcggccgggatcatgaagaaccccaccgtcgacggcatcatgaccatcgacctggaccccgtgatctacgacagcaagttcgagaagcagctcggccaggtgatgctgctggtcctctgcgccgtgcagctgctgctcatgcggacgtcctgggccctgtgcgaggccctgaccctcgcgaccggccccatcaccacgctgtgggagggcagcccggggaagttctggaacaccaccatcgccgtgtccatggccaacatcttccgcggcagctacctggccggggcgggcctcgccttctccatcatgaagtccgtcgggaccggccggcgcggcacggggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagaccacgcaccacgccgtgtcccgcggcagcgccaagctccagtggttcgtcgagcggaacatggtgatccccgaggggcgcgtgatcgacctgggctgcgggcgcggcgggtggtcctactactgcgcgggcctgaagaaggtcaccgaggtgcggggctacaccaagggcgggcccgggcacgaggagcccgtgccgatgagcacctacggctggaacatcgtcaagctcatgtccgggaaggacgtgttctacctgccgcccgagaagtgcgacacgctgctgtgcgacatcggcgagagctcccccagcccgaccgtggaggagtcccgcaccatccgggtcctcaagatggtggagccctggctgcgcaacaaccagttctgcatcaaggtgctgaacccctacatgcccaccgtcatcgagcacctcgagcggctgcagcgcaagtacggcgggatgctggtgcggaacccgctcagccgcaactccacgcacgagatgtactggatcagcaacggcaccgggaacatcgtgtccagcgtcaacatggtgtcccggctgctgctcaaccgcttcaccatgacccaccggcgccccacgatcgagaaggacgtcgacctgggcgccggcacccggcacgtgaacgccgagcccgagaccccgaacatggacgtgatcggggagcgcatcaagcggatcaaggaggagcacagctccacctggcactacgacgacgagaacccctacaagacgtgggcctaccacggcagctacgaggtcaaggccaccgggagcgcgtccagcatgatcaacggcgtggtgaagctgctcaccaagccctgggacgtcgtgcccatggtgacccagatggccatgacggacaccaccccgttcgggcagcagcgcgtcttcaaggagaaggtggacacccggacgccccgccccatgcccggcacccggaaggtgatggagatcaccgccgagtggctgtggcgcaccctgggccgcaacaagaagccgcggctctgcacgcgcgaggagttcaccaagaaggtccggaccaacgccgccatgggggcggtgttcaccgaggagaaccagtgggactccgcccgcgccgccgtggaggacgaggagttctggaagctggtcgacaaggagcgggagctgcacaagctcggcaagtgcgggagctgcgtgtacaacatgatgggcaagcgcgagaagaagctgggggagttcggcaaggcgaagggctcccgggccatctggtacatgtggctgggggcccgctacctcgagttcgaggccctgggcttcctgaacgaggaccactggttcagccgggagaactcctacagcggggtggagggcgaggggctccacaagctgggctacatcctgcgcgacatctccaagatccccggcggggccatgtacgcggacgacacggccggctgggacacccggatcaccgaggacgacctccacaacgaggagaagatcacccagcagatggaccccgggcaccgccagctggccaacgccatcttcaagctgacgtaccagaacaaggtcgtgaaggtgcagcggcccaccccgaagggcaccgtcatggacatcatcagccgcaaggaccagcggggctccggccaggtgggcacctacgggctcaacaccttcacgaacatggaggcccagctggtgcgccagatggagggcgagggggtcctgagcaaggcggacctcgagaacccccacctcctggagaagaagatcacccagtggctcgagaccaagggcgtggagcggctgaagcgcatggccatctccggcgacgactgcgtggtcaagcccatcgacgaccggttcgccaacgccctgctcgccctgaacgacatggggaaggtgcgcaaggacatcccccagtggcagccgagcaagggctggcacgactggcagcaggtccccttctgctcccaccacttccacgagctgatcatgaaggacgggcggaagctcgtcgtgccctgccgcccccaggacgagctgatcggccgcgcgcggatcagccagggggccggctggtccctgaaggagaccgcctgcctcggcaaggcctacgcccagatgtggagcctgatgtacttccaccgccgggacctgcgcctcgcgtccaacgccatctgcagcgccgtgccggtccactggatccccacgagccggaccacctggtccatccacgcccaccaccagtggatgaccacggaggacatgctgaccgtgtggaaccgcgtgtggatcgaggacaacccctggatggaggacaagacccccgtcaccacgtgggaggacgtgccgtacctggggaagcgggaggaccagtggtgcggcagcctcatcgggctgacctcccgcgcgacctgggcccagaacatcctgaccgccatccagcaggtccggagcctcatcggcgacgaggagttcctggactacatgccctccatgaagcgcttccggaaggaggaggagacggagggggccatctggtga

SEQ ID NO: 9956 - RNA, 9873 nt, synthetic construct
  misc_feature 1..9873: note = derived and/or modified CDS sequence (opt1) from DENV-3__FJ639715__SS-prME
  source 1..9873: mol_type = other RNA
accagcctgtgcctcatgatgatgctgcccgcgaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccaacatcttcgccggccacctgaagtgccggctcaagatggacaagctggagctgaagggcatgagctacgccatgtgcctcaacaccttcgtgctgaagaaggaggtctccgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccatcaacatcgaggccgagccgcccttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacgtggatcggcctgaacagcaagaacacctccatgagcttctcctgcatcgtgatcgggatcatcaccctgtacctcggcgccgtggtccaggccgacatggggtgcgtgatcaactggaagggcaaggagctgaagtgcggcaacgggatcttcgtgaccaacgaggtccacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggcgaagatcgtcaccgccgagacccagaactccagcttcatcatcgacggccccaacacccccgagtgcccctccgccagccgggcctggaacgtgtgggaggtggaggactacgggttcggcgtcttcacgaccaacatctggctgaagctccgcgaggtgtacacccagtcctgcgaccaccggctgatgagcgcggccatcaaggacgagcgcgccgtgcacgccgacatgggctactggatcgagagccagaagaacgggtcctggaagctggagaaggccagcttcatcgaggtcaagacctgcacctggccgaagtcccacacgctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcaccacggtggtcatcgccgagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtgaagtccctggtcagcgccggctccgggaaggtggacaacttcaccatgggcgtgctgtgcctcgccatcctgttcgaggaggtcatgcgggggaagttcggcaagaagcacatgatcgcgggggtgctgttcaccttcgtgctcctgctgagcggccagatcacgtggcgcgacatggcccacaccctcatcatgatcggctccaacgccagcgaccggatggggatgggcgtcacctacctggccctgatcgccaccttcaagatccagcccttcctcgcgctggggttcttcctgcgcaagctcacgtcccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgcagcaacacgatcttcaccctgaccgtcgcctggcgcaccgccacgctcatcctggccggggtgtccctgctcccgctgtgccagagctccagcatgcggaagaccgactggctgcccatgaccgtcgcggccatgggcgtgccgcccctgccgctgttcatcttctccctgaaggacacccccaagcgcaagagctggcccctcaacgagggggtgatggccgtcggcctggtgtccatcctggccagctccctcctgcgcaacgacgtgcccatggccggcccgctggtcgccggcgggctcctgatcgcctgctacgtgatcacggggaccagcgccgacctgaccgtggagaaggccgccgacgtcacctgggaggaggaggcggagcagacgggggtgtcccacaacctcatgatcaccgtggacgacgacgggaccatgcggatcaaggacgacgagaccgagaacatcctgaccgtcctgctcaagacggccctgctgatcgtgagcggcatcttcccctactccatccccgccaccctcctggtgtggcacacctggcagaagcagacccagcgcagcggcgtcctgtgggacgtgccctccccgcccgagacgcagaaggccgagctcgaggagggggtgtaccggatcaagcagcagggcatcttcgggaagacccaggtcggcgtgggggtgcagaaggagggcgtcttccacaccatgtggcacgtgacccgcggcgccgtgctgacgcacaacgggaagcggctggagcccaactgggcgagcgtcaagaaggacctcatctcctacggcgggggctggcgcctgagcgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggacctccggcagcccgatcatcaaccgggagggcaaggtggtggggctgtacggcaacggggtcgtgaccaagaacggcgggtacgtgagcggcatcgcccagaccaacgccgagcccgacggccccacgcccgagctcgaggaggagatgttcaagaagcgcaacctgaccatcatggacctgcacccggggtccggcaagacccggaagtacctccccgccatcgtccgcgaggccatcaagcggcgcctgcggaccctgatcctcgcgcccacgcgcgtggtggccgccgagatggaggaggccctgaaggggctgcccatccggtaccagaccaccgccaccaagagcgagcacacgggccgcgagatcgtcgacctcatgtgccacgcgaccttcaccatgcggctgctgtccccggtgcgcgtgcccaactacaacctcatcatcatggacgaggcccacttcaccgaccccgccagcatcgccgcccgggggtacatctccacgcgcgtcggcatgggcgaggcggccgccatcttcatgaccgccacgccgcccgggaccgcggaggccttcccccagagcaacgcccccatccaggacgaggagcgggacatccccgagcgctcctggaacagcggcaacgagtggatcacggacttcgtggggaagaccgtgtggttcgtcccctccatcaaggccggcaacgacatcgccaactgcctgcgcaagaacgggaagaaggtgatccagctgagccggaagaccttcgacaccgagtaccagaagacgcgcctcaacgactgggacttcgtggtcaccaccgacatctccgagatgggcgcgaacttcaaggccgaccgggtgatcgacccccgccggtgcctgaagcccgtgatcctgaccgacggccccgagcgcgtcatcctcgccgggccgatgcccgtgacggccgccagcgcggcccagcggcgcggccgggtggggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagagccggaagaccttcgtcgagctcatgcgccgcggggacctgcccgtgtggctggcccacaaggtcgcctccgagggcatcaagtacacggaccgcaagtggtgcttcgacggggagcggaacaaccagatcctcgaggagaacatggacgtggagatctggaccaaggagggcgagcgcaagaagctgcggccgcgctggctggacgcgcgcacctacagcgaccccctcgccctgaaggagttcaaggacttcgccgccggccggaagtccatcgccctggacctcgtgaccgagatcgggcgcgtccccagccacctggcgcaccggacgcgcaacgccctggacaacctcgtgatgctgcacacctccgagcacggcgggcgggcctaccgccacgccgtggaggagctgccggagaccatggagaccctcctgctgctcggcctgatgatcctgctcaccggcggggccatgctgttcctgatcagcgggaaggggatcggcaagaccagcatcgggctcatctgcgtcatcgtgtccagcggcatgctgtggatggcggacgtgcccctgcagtggatcgcctccgccatcgtcctcgagttcttcatgatggtgctgctgatccccgagcccgagaagcagcggaccccgcaggacaaccagctcgcctacgtggtcatcgggatcctgaccctggccgcgatcgtggccgccaacgagatgggcctcctggagacgaccaagcgcgacctgggcatgagcaaggagcccggggtggtctcccccaccagctacctcgacgtggacctgcaccccgcctccgcctggaccctgtacgcggtggccacgaccgtcatcaccccgatgctccggcacaccatcgagaacagcacggccaacgtgtccctggccgcgatcgccaaccaggccgtggtcctgatgggcctcgacaaggggtggcccatcagcaagatggacctgggcgtgcccctgctcgccctggggtgctactcccaggtgaaccccctgaccctcaccgccgcggtcctgctgctcgtgacccactacgccatcatcggcccgggcctgcaggccaaggccacgcgcgaggcccagaagcggaccgcggccgggatcatgaagaaccccaccgtggacggcatcatgaccatcgacctggaccccgtcatctacgacagcaagttcgagaagcagctcggccaggtgatgctgctggtgctctgcgccgtccagctgctgctcatgcgcacgtcctgggccctgtgcgaggccctgaccctcgcgaccggccccatcaccacgctgtgggagggcagcccggggaagttctggaacaccaccatcgccgtgtccatggccaacatcttccggggcagctacctggccggggcgggcctcgccttctccatcatgaagtccgtggggaccggccgccggggcacggggtcccagggcgagaccctgggggagaagtggaagaagaagctgaaccagctcagccgcaaggagttcgacctgtacaagaagtccggcatcaccgaggtcgaccggaccgaggccaaggaggggctgaagcgcggcgagaccacgcaccacgccgtgtcccggggcagcgccaagctccagtggttcgtggagcgcaacatggtcatccccgaggggcgggtgatcgacctgggctgcgggcgcggcgggtggtcctactactgcgcgggcctgaagaaggtgaccgaggtccgcggctacaccaagggcggccccgggcacgaggagcccgtgccgatgagcacctacggctggaacatcgtgaagctcatgtccgggaaggacgtcttctacctgccgcccgagaagtgcgacacgctgctgtgcgacatcggcgagagctcccccagcccgaccgtggaggagtcccggaccatccgcgtgctcaagatggtcgagccctggctgcggaacaaccagttctgcatcaaggtgctgaacccctacatgcccaacgtgatcgagcacctcgagcgcctgcagcggaagtacggcgggatgctggtccgcaacccgctcagccggaactccacccacgagatgtactggatcagcaacggcacggggaacatcgtgtccagcgtgaacatggtctcccgcctgctgctcaaccggttcaccatgacccaccgccggcccaccatcgagaaggacgtggacctgggcgccggcacgcgccacgtcaacgccgagcccgagaccccgaacatggacgtgatcggggagcggatcaagcgcatcaaggaggagcacagctccacctggcactacgacgacgagaacccctacaagacctgggcctaccacggcagctacgaggtgaaggccacggggtccgcgagcagcatgatcaacggcgtcgtgaagctgctcaccaagccctgggacgtggtccccatggtgacccagatggccatgaccgacacgaccccgttcgggcagcagcgggtgttcaaggagaaggtcgacacccgcacgccccggcccatgcccggcacgcgcaaggtgatggagatcaccgccgagtggctgtggcggaccctgggccgcaacaagaagccgcgcctctgcacccgggaggagttcacgaagaaggtgcgcaccaacgccgccatgggggcggtcttcaccgaggagaaccagtgggactccgcccgggccgccgtggaggacgaggagttctggaagctggtggacaaggagcgcgagctgcacaagctcggcaagtgcgggagctgcgtctacaacatgatgggcaagcgggagaagaagctgggggagttcggcaaggcgaagggctcccgcgccatctggtacatgtggctgggggcccggtacctcgagttcgaggccctgggcttcctgaacgaggaccactggttcagccgcgagaactcctacagcggggtggagggcgaggggctccacaagctgggctacatcctgcgggacatctccaagatccccggcggggccatgtacgcggacgacaccgccggctgggacacgcgcatcaccgaggacgacctccacaacgaggagaagatcacccagcagatggaccccgagcaccggcagctggccaacgccatcttcaagctgacctaccagaacaaggtggtcaaggtgcagcgccccacgccgaaggggaccgtgatggacatcatcagccggaaggaccagcgcggctccggccaggtcgggacctacggcctcaacaccttcaccaacatggaggcccagctggtgcggcagatggagggggagggcgtgctgagcgaggcggacctcgagaacccccacctcctggagaagaagatcacgcagtggctcgagaccaagggggtcgagcgcctgaagcggatggccatctccggcgacgactgcgtggtgaagcccatcgacgaccgcttcgccaacgccctgctcgccctgaacgacatgggcaaggtccggaaggacatcccccagtggcagccgagcaaggggtggcacgactggcagcaggtccccttctgctcccaccacttccacgagctgatcatgaaggacggccgcaagctcgtggtcccctgccggccccaggacgagctgatcgggcgcgcgcgcatcagccagggcgccgggtggtccctgaaggagaccgcctgcctcggcaaggcctacgcccagatgtggagcctgatgtacttccaccggcgcgacctgcggctcgcgtccaacgccatctgcagcgccgtgccggtgcactggatccccacctcccgcacgacctggagcatccacgcccaccaccagtggatgaccaccgaggacatgctgacggtctggaaccgggtgtggatcgaggacaacccctggatggaggacaagacccccgtgaccacctgggaggacgtcccgtacctgggcaagcgcgaggaccagtggtgcgggagcctcatcggcctgacgtcccgggcgacctgggcccagaacatcctgaccgccatccagcaggtccgcagcctcatcggggacgaggagttcctggactacatgccctccatgaagcggttccgcaaggaggaggagagcgagggcgccatctggtga

SEQ ID NO: 9957 - RNA, 9873 nt, synthetic construct
  misc_feature 1..9873: note = derived and/or modified CDS sequence (opt1) from DENV-3__KF955461__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccaccctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggccagcaccgtggaggccgtgctgcccgagtacggcaccctcgggctggagtgctccccgcgcaccggcctggacttcaacgagatgatcctcctgacgatgaagaacaaggcgtggatggtccaccggcagtggttcttcgacctgcccctcccctggaccagcggcgccaccaccgagacgcccacctggaaccgcaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtctccgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccaggtcttcgggtccgcgtacaccgccctgttcagcggcgtgtcctggatcatgaagatcggcatcggggtgctgctcacgtggatcggcctgaacagcaagaacacctccatgagcttctcctgcatcgtcatcgggatcatcaccctgtacctcggcgccgtggtgcaggccgacatggggtgcgtcatcaactggaagggcaaggagctgaagtgcggcagcgggatcttcgtgaccaacgaggtgcacacgtggaccgagcagtacaagttccaggccgactcccccaagcgcctggcgaccgccatcgccggcgcctgggagaacggggtctgcggcatccgcagcaccacgcggatggagaacctcctgtggaagcagatcgccaacgagctgaactacatcctctgggagaacaacatcaagctgaccgtggtggtcggggacatcatcggcgtgctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgcctcccgggcctggaacgtctgggaggtggaggactacgggttcggcgtgttcacgaccaacatctggctgaagctccgcgaggtctacacccagagctgcgaccaccggctgatgagcgcggccatcaaggacgagcgcgccgtgcacgccgacatgggctactggatcgagtcccagaagaacgggagctggaagctggagaaggcctccttcatcgaggtgaagacctgcacctggcccaagagccacacgctctggtccaacggcgtcctggagagcgacatgatcatccccaagtccctggcggggcccatcagccagcacaaccaccggccgggctaccacacccagaccgccgggccctggcacctcggcaagctggagctggacttcaactactgcgagggcaccacggtggccatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcacgttcgtcctcctgctgtccggccagatcacctggcgcgacatggcccacaccctcatcatgatcggcagcaacgcctccgaccggatggggatgggcgtgacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtcagcctgacgtgctccaacaccatcttcaccctgaccgtggcctggcgcacggccaccctcatcctggccggggtcagcctgctcccgctgtgccagtccagctccatgcggaagaccgactggctgcccatgaccgtggcggccatgggcgtgccgcccctcccgctgttcatcttcagcctgaaggacacgcccaagcgccgctcctggcccctcaacgagggggtcatggccgtgggcctggtgagcatcctggcctccagcctcctgcggaacgacgtccccatggccggcccgctggtggccggcgggctcctgatcgcctgctacgtgatcaccgggacctccgccgacctgaccgtcgagaaggccgccgacgtgacgtgggaggaggaggcggagcagaccggggtgagccacaacctcatgatcaccgtcgacgacgacgggaccatgcgcatcaaggacgacgagaccgagaacatcctgacggtgctgctcaagaccgccctgctgatcgtgtccggcatcttcccctacagcatccccgccaccctcctggtctggcacacctggcagaagcagacgcagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggcgtccgtgaagaaggacctcatcagctacggcgggggctggcggctgtccgcccagtggcagaagggggaggaggtgcaggtcatcgccgtggagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtcgggctgtacggcaacggggtggtgaccaagaacggcgggtacgtctccggcatcgcccagacgaacgccgagcccgacggccccacccccgagctcgaggaggagatgttcaagaagcggaacctgaccatcatggacctgcacccggggagcggcaagacccgcaagtacctccccgccatcgtgcgggaggccatcaagcgccggctgcgcacgctgatcctcgcgcccacccgggtggtcgccgccgagatggaggaggccctgaaggggctgcccatccgctaccagaccaccgccacgaagtccgagcacaccggccgggagatcgtggacctcatgtgccacgcgaccttcaccatgcgcctgctgagcccggtgcgggtccccaactacaacctcgtgatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgccaactgcctgcggaagaacgggaagaaggtcatccagctgtcccgcaagaccttcgacacggagtaccagaagacccggctcaacgactgggacttcgtggtgaccaccgacatcagcgagatgggcgcgaacttcaaggccgaccgcgtcatcgacccccggcgctgcctgaagcccgtgatcctgacggacggccccgagcgggtgatcctcgccgggccgatgcccgtcaccgccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgacggagatcgggcgggtgccctcccacctggcgcaccgcacccggaacgccctggacaacctcgtcatgctgcacaccagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgacgctggccgcgatcgtcgccgccaacgagatgggcctcctggagaccaccaagcgggacctgggcatgtccaaggagcccggggtggtgagccccacctcctacctcgacgtcgacctgcaccccgccagcgcctggacgctgtacgcggtggccaccaccgtgatcaccccgatgctccgccacacgatcgagaactccaccgccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacgcactacgccatcatcggcccgggcctgcaggccaaggccacccgggaggcccagaagcgcaccgcggccgggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgcgaccggccccatcacgaccctgtgggagggctccccggggaagttctggaacaccaccatcgccgtcagcatggccaacatcttccgcggctcctacctggccggggcgggcctcgccttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacgtacggctggaacatcgtgaagctcatgagcgggaaggacgtgttctacctgccgcccgagaagtgcgacaccctgctgtgcgacatcggcgagtccagcccctccccgaccgtcgaggagagccgcaccatccgggtgctcaagatggtggagccctggctgaagaacaaccagttctgcatcaaggtcctgaacccctacatgcccacggtgatcgagcacctcgagcgcctgcagcggaagtacggcgggatgctggtgcgcaacccgctctcccggaacagcacccacgagatgtactggatctccaacggcaccgggaacatcgtcagctccgtgaacatggtcagccgcctgctgctcaaccggttcaccatgacgcaccgccggcccaccatcgagaaggacgtggacctgggcgccggcacccgccacgtgaacgccgagcccgagaccccgaacatggacgtcatcggggagcggatcaagcgcatcaaggaggagcactccagcacgtggcactacgacgacgagaacccctacaagacctgggcctaccacggctcctacgaggtgaaggccaccgggagcgcgagctccatgatcaacggcgtggtcaagctgctcaccaagccctgggacgtggtgcccatggtcacgcagatggccatgaccgacaccaccccgttcgggcagcagcgggtgttcaaggagaaggtggacacgcgcacgccccggcccatgcccggcacccgcaaggtcatggagatcaccgccgagtggctgtggcggacgctgggccgcaacaagaagccgcgcctctgcacccgggaggagttcaccaagaaggtgcgcaccaacgccgccatgggggcggtgttcacggaggagaaccagtgggacagcgcccgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgcggacgacaccgccggctgggacacccggatcaccgaggacgacctccacaacgaggagaagatcacgcagcagatggaccccgagcaccgccagctggccaacgccatcttcaagctgacctaccagaacaaggtggtgaaggtccagcggcccaccccgaaggggaccgtgatggacatcatctcccgcaaggaccagcggggcagcggccaggtggggacctacggcctcaacacgttcaccaacatggaggcccagctggtccgccagatggagggggagggcgtgctgtccaaggcggacctcgagaacccccaccagctggagaagaagatcacccagtggctggagaccaagggggtggagcggctcaagcgcatggccatcagcggcgacgactgcgtcgtgaagcccatcgacgaccggttcgccaacgccctgctggccctcaacgacatgggcaaggtgcgcaaggacatcccccagtggcagccgtccaaggggtggcacgactggcagcaggtccccttctgcagccaccacttccacgagctgatcatgaaggacggccggaagctggtggtgccctgccgcccccaggacgagctcatcgggcgcgcgcggatctcccagggcgccgggtggagcctgaaggagacggcctgcctgggcaaggcctacgcccagatgtggtccctcatgtacttccaccgccgggacctgcgcctggcgagcaacgccatctgctccgccgtcccggtgcactggatccccaccagccggaccacctggagcatccacgcccaccaccagtggatgacgaccgaggacatgctcaccgtgtggaaccgcgtctggatcgaggacaacccctggatggaggacaagacccccgtgacgacctgggaggacgtgccgtacctgggcaagcgggaggaccagtggtgcgggtccctgatcggcctcaccagccgcgcgacctgggcccagaacatcctgacggccatccagcaggtccggtccctgatcggggacgaggagttcctcgactacatgcccagcatgaagcgcttccggaaggaggaggagtccgagggcgccatctggtga

SEQ ID NO: 9958 - RNA, 9873 nt, synthetic construct
  misc_feature 1..9873: note = derived and/or modified CDS sequence (opt1) from DENV-3__FJ639719__SS-prME
  source 1..9873: mol_type = other RNA
accagcctgtgcctcatgatgatgctgcccgccaccctggccttccacctcaccagccgggacggggagccccggatgatcgtggggaagaacgagcgcggcaagagcctgctgttcaagaccgcgaccgggatcaacatgtgcaccctcatcgccatggacctgggcgagatgtgcgacgacaccgtgacctacaagtgccccctgatcgccgaggtggagcccgaggacatcgactgctggtgcaacctcacctccacctgggtgacgtacgggacctgcaaccaggccggcgagcaccggcgcgacaagcggagcgtcgccctggcgccccacgtgggcatggggctggacacccgcacccagacgtggatgtccgccgagggcgcctggcgccaggtggagaaggtcgagacctgggccctccgccacccggggttcaccatcctggcgctgttcctcgcccactacatcggcaccagcctgatccagaaggtggtgatcttcatcctgctcatgctggtcacgccctccatgaccatgcggtgcgtgggggtgggcaaccgcgacttcgtcgagggcctgagcggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgactcccgctgccccacgcagggcgaggccatcctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggcctccaccgtggaggccgtgctgcccgagtacggcaccctcgggctggagtgcagcccgcgcaccggcctggacttcaacgagatgatcctcctgaccatgaagaacaaggcgtggatggtccaccggcagtggttcttcgacctgcccctcccctggacgtccggcgccaccaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacccagcacgggacgatcctgatcaaggtggagtacaagggcgaggacgccccgtgcaagatccccttctccaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggcagctccatcgggaagatgttcgaggcgacggcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacctggacggagcagtacaagttccaggccgacagccccaagcgcctggcgaccgccatcgccggcgcctgggagaacggggtgtgcggcatccgctccaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtacagctggaagacctgggggaaggcgaagatcgtgacggccgagacccagaactccagcttcatcatcgacggccccaacacccccgagtgcccctccgccagccgggcctggaacgtgtgggaggtcgaggactacgggttcggcgtgttcaccacgaacatctggctgaagctccgcgaggtgtacacccagtcctgcgaccaccggctgatgagcgcggccatcaaggacgagcgcgccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcaccttcgtcctcctgctgagcggccagatcacgtggcgcgacatggcgcacaccctcatcatgatcggctccaacgccagcgaccggatggggatgggcgtgacccacctggccctgatcgccaccttcaagatccagcccttcctcgccctggggttcttcctgcgcaagctcacgtcccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgcagcaacacgatcttcaccctgaccgtggcctggcgcaccgccacgctcatcctggccggggtctccctgctcccgctgtgccagagctccagcatgcggaagaccgactggctgcccatgaccgtggccgcgatgggcgtgccgcccctgccgctgttcatcttctccctgaaggacacccccaagcgccgcagctggcccctcaacgagggggtcatggccgtgggcctggtgtccatcctggccagctccctcctgcggaacgacgtccccatggccggcccgctggtggccgggggcctcctgatcgcgtgctacgtgatcacggggaccagcgccgacctgaccgtcgagaaggccgccgacgtgacctgggaggaggaggccgagcagacgggcgtgtcccacaacctcatgatcaccgtcgacgacgacgggaccatgcgcatcaaggacgacgagaccgagaacatcctgaccgtgctgctcaagacggcgctgctgatcgtgagcggcatcttcccctactccatccccgccaccctcctggtctggcacacctggcagaagcagacccagcggagcggcgtgctgtgggacgtgccctccccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggccagcgtgaagaaggacctcatctcctacggcgggggctggcggctgagcacccagtggcagaagggggaggaggtgcaggtcatcgcggtggagcccggcaagaacccgaagaacttccagaccatgcccggcatcttccagaccacgaccggggagatcggcgccatcgccctggacttcaagcccgggacctccggcagcccgatcatcaaccgcgagggcaaggtggtcgggctgtacggcaacggggtggtgaccaagaacggcgggtacgtcagcggcatcgcccagacgaacgcggagcccgacggccccacccccgagctcgaggaggagatgttcaagaagcggaacctgaccatcatggacctgcacccggggtccggcaagacccgcaagtacctccccgccatcgtgcgggaggccatcaagcgccggctgcgcacgctgatcctcgcccccacccgggtggtcgccgcggagatggaggaggccctgaaggggctgcccatccgctaccagaccaccgccaccaagagcgagcacaccggccgggagatcgtggacctcatgtgccacgccaccttcaccatgcgcctgctgtccccggtgcgggtccccaactacaacctcatcatcatggacgaggcccacttcacggaccccgcgagcatcgccgcccgcgggtacatctccacccgggtgggcatgggcgaggccgccgcgatcttcatgaccgccacgccgcccgggacggccgaggccttcccccagagcaacgcgcccatccaggacgaggagcgcgacatccccgagcgctcctggaacagcggcaacgagtggatcaccgacttcgtggggaagaccgtctggttcgtgccctccatcaaggccggcaacgacatcgccaactgcctgcggaagaacgggaagaaggtgatccagctgagccgcaagaccttcgacacggagtaccagaagacccggctcaacgactgggacttcgtcgtgaccaccgacatctccgagatgggcgccaacttcaaggccgaccgcgtgatcgacccccggcgctgcctgaagcccgtcatcctgacggacggccccgagcgggtgatcctcgcggggccgatgcccgtgaccgccgccagcgccgcccagcgccggggccgcgtcgggcggaacccccagaaggagaacgaccagtacatcttcaccggccagcccctgaacaacgacgaggaccacgcgcactggaccgaggccaagatgctgctcgacaacatcaacaccccggaggggatcatccccgccctgttcgagcccgagcgcgagaagtccgccgccatcgacggcgagtaccggctgaagggcgagagccgcaagacgttcgtggagctcatgcggcgcggggacctgcccgtctggctggcgcacaaggtggcctccgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcccggacctacagcgaccccctcgccctgaaggagttcaaggacttcgcggccggccgcaagtccatcgccctggacctcgtcacggagatcgggcgggtgcccagccacctggcccaccgcacccggaacgccctggacaacctcgtgatgctgcacacctccgagcacggcgggcgcgcgtaccggcacgccgtcgaggagctgccggagaccatggagacgctcctgctgctcggcctgatgatcctgctcaccgggggcgccatgctgttcctggtgagcggcaaggggatcggcaagaccaccatcgggctcatctgcgtgatcgtcagctccggcatgctgtggatggccgacatccccctgcagtggatcgccagcgcgatcgtgctcgagttcttcatgatggtgctgctgatccccgagcccgagaagcagcgcacgccgcaggacaaccagctcgcctacgtcgtgatcgggatcctgaccctggccgccatcgtggccgcgaacgagatgggcctcctggagaccaccaagcgggacctgggcatgtccaaggagcccggggtcgtgagccccacgtcctacctcgacgtggacctgcaccccgccagcgcctggaccctgtacgccgtcgccaccaccgtgatcacgccgatgctccgccacaccatcgagaactccaccgcgaacgtgagcctggccgccatcgccaaccaggcggtcgtgctgatgggcctcgacaaggggtggcccatctccaagatggacctgggcgtgcccctgctcgccctggggtgctacagccaggtcaaccccctgaccctcacggccgccgtgctgctgctcgtgacccactacgccatcatcggcccgggcctgcaggcgaaggccacccgggaggcccagaagcgcaccgccgccgggatcatgaagaaccccacggtcgacggcatcatgaccatcgacctggaccccgtgatctacgactccaagttcgagaagcagctcggccaggtgatgctgctggtcctctgcgcggtgcagctgctgctcatgcggaccagctgggccctgtgcgaggccctgaccctcgccacgggccccatcaccaccctgtgggagggctccccggggaagttctggaacaccacgatcgccgtgagcatggcgaacatcttccgcggctcctacctggccggggccggcctcgccttcagcatcatgaagtccgtcgggaccggccggcgcggcaccgggagccagggcgagaccctgggggagaagtggaagaagaagctgaaccagctctcccggaaggagttcgacctgtacaagaagtccggcatcaccgaggtggaccgcacggaggcgaaggaggggctgaagcggggcgagaccacccaccacgccgtgagccgcggctccgccaagctccagtggttcgtcgagcggaacatggtgatccccgaggggcgcgtgatcgacctgggctgcgggcgcggcgggtggagctactactgcgccggcctgaagaaggtcaccgaggtgcggggctacacgaagggcgggcccgggcacgaggagcccgtgccgatgtccacctacggctggaacatcgtcaagctcatgagcgggaaggacgtgttctacctgccgcccgagaagtgcgacaccctgctgtgcgacatcggcgagtccagcccctccccgaccgtggaggagagccgcacgatccgggtcctcaagatggtggagccctggctgaagaacaaccagttctgcatcaaggtgctgaacccctacatgcccaccgtcatcgagcacctcgagcgcctgcagcggaagtacggcgggatgctggtgcgcaacccgctctcccggaacagcacccacgagatgtactggatctccaacggcaccgggaacatcgtgagctccgtcaacatggtgagccgcctgctgctcaaccggttcacgatgacccaccgccggcccaccatcgagaaggacgtcgacctgggcgccggcacccgccacgtgaacgcggagcccgagacgccgaacatggacgtgatcggggagcggatcaagcgcatcaaggaggagcactccagcacctggcactacgacgacgagaacccctacaagacctgggcctaccacggctcctacgaggtcaaggccaccgggagcgcctccagcatgatcaacggcgtggtgaagctgctcacgaagccctgggacgtcgtgcccatggtgacccagatggccatgaccgacaccacgccgttcgggcagcagcgggtcttcaaggagaaggtggacacccgcacgccccggcccatgcccggcacccgcaaggtgatggagatcacggcggagtggctgtggcggaccctgggccgcaacaagaagccgcgcctctgcacccgggaggagttcaccaagaaggtccgcacgaacgccgccatgggggccgtgttcaccgaggagaaccagtgggacagcgcccgggcggccgtggaggacgaggagttctggaagctggtcgaccgcgagcgggagctgcacaagctcggcaagtgcgggtcctgcgtgtacaacatgatgggcaagcgcgagaagaagctgggggagttcggcaaggccaagggcagccgggccatctggtacatgtggctgggggcgcgcttcctcgagttcgaggccctgggcttcctgaacgaggaccactggttctcccgggagaacagctactccggggtggagggcgaggggctccacaagctgggctacatcctgcgcgacatcagcaagatccccggcggggccatgtacgccgacgacaccgccggctgggacacccggatcacggaggacgacctccacaacgaggagaagatcacccagcagatggaccccgagcaccgccagctggcgaacgccatcttcaagctgacctaccagaacaaggtcgtgaaggtgcagcggcccaccccgaaggggaccgtcatggacatcatctcccgcaaggaccagcggggcagcggccaggtggggacgtacggcctcaacaccttcaccaacatggaggcccagctggtgcgccagatggagggggagggcgtcctgtccaaggccgacctcgagaacccccacctcctggagaagaagatcacccagtggctcgagaacaagggggtggagcggctgaagcgcatggccatcagcggcgacgactgcgtggtcaagcccatcgacgaccggttcgcgaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtcgtgccctgccgcccccaggacgagctgatcgggcgcgcccggatctcccagggcgccgggtggagcctgaaggagacggcgtgcctcggcaaggcctacgcccagatgtggtccctgatgtacttccaccgccgggacctgcgcctcgccagcaacgccatctgctccgcggtgccggtccactgggtgcccaccagccggaccacctggtccatccacgcccaccaccagtggatgacgaccgaggacatgctgaccgtgtggaaccgcgtctggatcgaggacaacccctggatggaggacaagacccccgtgacgacctgggaggacgtgccgtacctgggcaagcgggaggaccagtggtgcgggagcctcatcggcctgaccagccgcgccacctgggcccagaacatcctgacggcgatccagcaggtccggtccctcatcggggacgaggagttcctggactacatgcccagcatgaagcgcttccggaaggaggaggagtccgagggcgccatctggtga

SEQ ID NO: 9959 - RNA, 9873 nt, synthetic construct
  misc_feature 1..9873: note = derived and/or modified CDS sequence (opt1) from DENV-3__KF955332__SS-prME
  source 1..9873: mol_type = other RNA
accagcctgtgcctcatgatgatgctgcccgcgaccctggccttccacctcaccagccgggacggcgagccccggatgatcgtggggaagaacgagcgcggcaagagcctgctgttcaagaccgcgaccgggatcaacatgtgcaccctcatcgccatggacctgggcgagatgtgcgacgacacggtgacctacaagtgccccctgatcgccgaggtggagcccgaggacatcgactgctggtgcaacctcacctccacctgggtgacgtacgggacctgcaaccaggccggcgagcaccggcgcgacaagcggagcgtcgccctggcgccccacgtgggcatggggctggacacccgcacccagacgtggatgtccgccgagggcgcctggcgccaggtggagaaggtcgagacctgggccctccgccacccggggttcaccatcctggcgctgttcctcgcccactacatcggcaccagcctgatccagaaggtggtgatcttcatcctgctcatgctggtcacgccctccatgaccatgcggtgcgtgggggtgggcaaccgcgacttcgtcgagggcctgagcggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgactcccgctgccccacgcagggcgaggccatcctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggcctccaccgtggaggccgtgctgcccgagtacggcaccctcgggctggagtgcagcccgcgcaccggcctggacttcaacgagatgatcctcctgaccatgaagaacaaggcgtggatggtccaccggcagtggttcttcgacctgcccctcccctggacgtccggcgccaccaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacccagcacgggacgatcctgatcaaggtggagtacaagggcgaggacgccccgtgcaagatccccttctccaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggcagctccatcgggaagatgttcgaggcgacggcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacctggacggagcagtacaagttccaggccgacagccccaagcgcctggcgaccgccatcgccggcgcctgggagaacggggtgtgcggcatccgctccaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtacagctggaagacctgggggaaggcgaagatcgtgacggccgagacccagaactccagcttcatcatcgacggccccaacacccccgagtgcccctccgccagccgggcctggaacgtgtgggaggtcgaggactacgggttcggcgtgttcaccacgaacatctggctgaagctccgcgaggtgtacacccagtcctgcgaccaccggctgatgagcgcggccatcaaggacgagcgcgccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcaccttcgtcctcctgctgagcggccagatcacgtggcgcgacatggcgcacaccctcatcatgatcggctccaacgccagcgaccggatggggatgggcgtgacctacctggccctgatcgccaccttcaagatccagcccttcctcgccctggggttcttcctgcgcaagctcacgtcccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgcagcaacacgatcttcaccctgaccgtggcctggcgcaccgccacgctcatcctggccggggtctccctgctcccgctgtgccagagctccagcatgcggaagaccgactggctgcccatgaccgtggccgcgatgggcgtgccgcccctgccgctgttcatcttctccctgaaggacgcccccaagcgccgcagctggcccctcaacgagggggtcatggccgtgggcctggtgtccatcctggccagctccctcctgcggaacgacgtccccatggccggcccgctggtggccggcgggctcctgatcgcctgctacgtgatcaccgggacgagcgccgacctgaccgtcgagaaggccgccgacgtgacctgggaggaggaggcggagcagaccggggtgtcccacaacctcatgatcacggtcgacgacgacgggaccatgcgcatcaaggacgacgagaccgagaacatcctgaccgtgctgctcaagaccgccctgctgatcgtgagcggcatcttcccctactccatccccgccacgctcctggtctggcacacctggcagaagcagacccagcggagcggcgtgctgtgggacgtgccctccccgcccgagacccagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacccacaacgggaagcgcctggagcccaactgggcgagcgtgaagaaggacctcatctcctacggcgggggctggcggctgagcacgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggacctccggcagcccgatcatcaaccgcgagggcaaggtggtcgggctgtacggcaacggggtggtgaccaagaacggcgggtacgtcagcggcatcgcgcagaccaacgccgagcccgacggccccacgcccgagctcgaggaggagatgttcaagaagcggaacctgaccatcatggacctgcacccggggtccggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagagcgagcacacgggccgggagatcgtggacctcatgtgccacgccaccttcaccatgcgcctgctgtccccggtgcgggtccccaactacaacctcatcatcatggacgaggcgcacttcaccgaccccgccagcatcgccgcccgcgggtacatctccacgcgggtgggcatgggcgaggccgcggccatcttcatgaccgccacgccgcccgggaccgccgaggcgttcccccagagcaacgcccccatccaggacgaggagcgcgacatccccgagcgctcctggaacagcggcaacgagtggatcacggacttcgtggggaagaccgtctggttcgtgccctccatcaaggccggcaacgacatcgccaactgcctgcggaagaacgggaagaaggtgatccagctgagccgcaagaccttcgacaccgagtaccagaagacgcggctcaacgactgggacttcgtcgtgaccaccgacatctccgagatgggcgccaacttcaaggcggaccgcgtgatcgacccccggcgctgcctgaagcccgtcatcctgaccgacggccccgagcgggtgatcctcgccgggccgatgcccgtgacggccgccagcgccgcgcagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagagccgcaagaccttcgtggagctcatgcggcgcggggacctgcccgtctggctggcccacaaggtggcctccgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcccggacctacagcgaccccctcgcgctgaaggagttcaaggacttcgccgccggccgcaagtccatcgccctggacctcgtcaccgagatcgggcgggtgcccagccacctggcccaccgcacgcggaacgcgctggacaacctcgtgatgctgcacacctccgagcacggcgggcgcgcctaccggcacgccgtcgaggagctgccggagaccatggagaccctcctgctgctcggcctgatgatcctgctcaccggcggggccatgctgttcctggtgagcgggaaggggatcggcaagaccaccatcgggctcatctgcgtgatcgtcagctccggcatgctgtggatggccgacatccccctgcagtggatcgcgagcgccatcgtgctcgagttcttcatgatggtgctgctgatccccgagcccgagaagcagcgcaccccgcaggacaaccagctcgcctacgtcgtgatcgggatcctgacgctggccgccatcgtggcggccaacgagatgggcctcctggagaccaccaagcgggacctgggcatgtccaaggagcccggggtcgtgagccccacctcctacctcgacgtggacctgcaccccgccagcgcctggacgctgtacgccgtcgcgaccaccgtgatcaccccgatgctccgccacacgatcgagaactccaccgccaacgtgagcctggccgccatcgcgaaccaggccgtcgtgctgatgggcctcgacaaggggtggcccatctccaagatggacctgggcgtgcccctgctcgccctggggtgctacagccaggtcaaccccctgaccctcaccgccgccgtgctgctgctcgtgacgcactacgcgatcatcggcccgggcctgcaggccaaggccacccgggaggcccagaagcgcaccgccgcggggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggccctgaccctcgccaccggccccatcacgaccctgtgggagggctccccggggaagttctggaacaccaccatcgcggtgagcatggccaacatcttccgcggctcctacctggccggggccggcctcgcgttcagcatcatgaagtccgtcgggacgggccggcgcggcaccgggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagacgacccaccacgccgtgagccgcggctccgccaagctccagtggttcgtcgagcggaacatggtgatccccgaggggcgcgtgatcgacctgggctgcgggcgcggcgggtggagctactactgcgccggcctgaagaaggtcaccgaggtgcggggctacaccaagggcggccccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccgcaccatccgggtcctcaagatggtggagccctggctgaagaacaaccagttctgcatcaaggtgctgaacccctacatgcccacggtcatcgagcacctcgagcgcctgcagcggaagtacggcgggatgctggtgcgcaacccgctctcccggaacagcacccacgagatgtactggatctccaacggcaccgggaacatcgtgagctccgtcaacatggtgagccgcctgctgctcaaccggttcaccatgacgcaccgccggcccaccatcgagaaggacgtcgacctgggcgcgggcacccgccacgtgaacgccgagcccgagaccccgaacatggacgtgatcggggagcggatcaagcgcatcaaggaggagcactccagcacgtggcactacgacgacgagaacccctacaagacctgggcctaccacggctcctacgaggtcaaggccaccgggagcgcctccagcatgatcaacggcgtggtgaagctgctcaccaagccctgggacgtcgtgcccatggtgacgcagatggcgatgaccgacaccaccccgttcgggcagcagcgggtcttcaaggagaaggtggacacgcgcacgccccggcccatgcccggcacccgcaaggtgatggagatcaccgccgagtggctgtggcggacgctgggccgcaacaagaagccgcgcctctgcacccgggaggagttcaccaagaaggtccgcaccaacgccgccatgggggccgtgttcacggaggagaaccagtgggacagcgcgcgggccgccgtggaggacgaggagttctggaagctggtcgaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttctcccgggagaacagctactccggggtggagggcgaggggctccacaagctgggctacatcctgcgcgacatcagcaagatccccggcggggccatgtacgccgacgacaccgcgggctgggacacccggatcaccgaggacgacctccacaacgaggagaagatcacgcagcagatggaccccgagcaccgccagctggccaacgccatcttcaagctgacctaccagaacaaggtcgtgaaggtgcagcggcccaccccgaaggggaccgtcatggacatcatctcccgcaaggaccagcggggcagcggccaggtggggacctacggcctcaacacgttcaccaacatggaggcccagctggtgcgccagatggagggggagggcgtcctgtccaagaccgacctcgagaacccccacctcctggagaagaagatcacccagtggctcgagaacaagggggtggagcggctgaagcgcatggccatcagcggcgacgactgcgtggtcaagcccatcgacgaccggttcgcgaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtcgtgccctgccgcccccaggacgagctgatcgggcgcgcccggatctcccagggcgccgggtggagcctgaaggagacggcgtgcctcggcaaggcctacgcccagatgtggtccctgatgtacttccaccgccgggacctgcgcctcgccagcaacgccatctgctccgcggtgccggtccactgggtgcccaccagccggaccacctggtccatccacgcccaccaccagtggatgacgaccgaggacatgctgaccgtgtggaaccgcgtctggatcgaggacaacccctggatggaggacaagacccccgtgacgacctgggaggacgtgccgtacctgggcaagcgggaggaccagtggtgcgggagcctcatcggcctgaccagccgcgccacctgggcccagaacatcctgacggcgatccagcaggtccggtccctcatcggggacgaggagttcctggactacatgcccagcatgaagcgcttccggaaggaggaggagtccgagggcgccatctggtga

SEQ ID NO: 9960 - RNA, 9873 nt, synthetic construct
  misc_feature 1..9873: note = derived and/or modified CDS sequence (opt1) from DENV-3__FJ639720__SS-prME
  source 1..9873: mol_type = other RNA
accagcctctgcctcatgatgatgctccccgccaccctggccttccacctcaccagccgggacggggagccccggatgatcgtggggaagaacgagcgcggcaagagcctgctgttcaagaccgcgaccgggatcaacatgtgcaccctcatcgccatggacctgggcgagatgtgcgacgacaccgtgacctacaagtgccccctgatcgccgaggtggagcccgaggacatcgactgctggtgcaacctcacctccacctgggtgacgtacgggacctgcaaccaggccggcgagcaccggcgcgacaagcggagcgtcgccctggcgccccacgtgggcatggggctggacacccgcacccagacgtggatgtccgccgagggcgcctggcgccaggtggagaaggtcgagacctgggccctccgccacccggggttcaccatcctggcgctgttcctcgcccactacatcggcaccagcctgatccagaaggtggtgatcttcatcctgctcatgctggtcacgccctccatgaccatgcggtgcgtgggggtgggcaaccgcgacttcgtcgagggcctgagcggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgactcccgctgccccacgcagggcgaggccatcctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggcctccaccgtggaggccgtgctgcccgagtacggcaccctcgggctggagtgcagcccgcgcaccggcctggacttcaacgagatgatcctcctgaccatgaagaacaaggcgtggatggtccaccggcagtggttcttcgacctgcccctcccctggacgtccggcgccaccaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacccagcacgggacgatcctgatcaaggtggagtacaagggcgaggacgccccgtgcaagatccccttctccaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctccggatcaactggtacaagaagggcagctccatcgggaagatgttcgaggcgacggcccgcggcgcccggcgcatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacctggacggagcagtacaagttccaggccgacagccccaagcgcctggcgaccgccatcgccggcgcctgggagaacggggtgtgcggcatccggtccaccacccgcatggagaacctcctgtggaagcagatcgccaacgagctgaactacatcctctgggagaacaacatcaagctgacggtcgtggtgggggacatcatcggcgtcctggagcagggcaagcggaccctcacgccccagccgatggagctgaagtacagctggaagacctgggggaaggcgaagatcgtgacggccgagacccagaactccagcttcatcatcgacggccccaacacccccgagtgcccctccgccagccgcgcctggaacgtgtgggaggtcgaggactacgggttcggcgtgttcaccacgaacatctggctgaagctccgggaggtgtacacccagtcctgcgaccaccgcctgatgagcgcggccatcaaggacgagcgggccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccgcccgggctaccacacgcagaccgccgggccctggcacctcggcaagctggagctggacttcaactactgcgagggcaccaccgtcgtgatcacggagaactgcgggacccggggccccagcctccgcaccaccacggtgtccgggaagctgatccacgagtggtgctgccggagctgcaccctgcccccgctccgctacatgggcgaggacgggtgctggtacggcatggagatccggcccatcaacgagaaggaggagaacatggtcaagtccctggtgagcgccggctccgggaaggtggacaacttcaccatgggcgtcctgtgcctcgccatcctgttcgaggaggtgatgcgcgggaagttcggcaagaagcacatgatcgccggggtgctgttcaccttcgtcctcctgctgagcggccagatcacgtggcgggacatggcgcacaccctcatcatgatcggctccaacgccagcgaccgcatggggatgggcgtgacctacctggccctgatcgccaccttcaagatccagcccttcctcgccctggggttcttcctgcggaagctcacgtcccgcgagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgcagcaacacgatcttcaccctgaccgtggcctggcggaccgccacgctcatcctggccggggtctccctgctcccgctgtgccagagctccagcatgcgcaagaccgactggctgcccatgaccgtggccgcgatgggcgtgccgcccctcccgctgttcatcttctccctgaaggacacccccaagcgccggagctggcccctcaacgagggggtcatggccgtgggcctggtgtccatcctggccagctccctcctgcgcaacgacgtccccatggccggcccgctggtggccgggggcctcctgatcgcgtgctacgtgatcacggggaccagcgccgacctgaccgtcgagaaggccgccgacgtgacctgggaggaggaggccgagcagacgggcgtgtcccacaacctcatgatcaccgtcgacgacgacgggaccatgcggatcaaggacgacgagaccgagaacatcctgaccgtgctgctcaagacggcgctgctgatcgtgagcggcatcttcccctactccatccccgccaccctcctggtctggcacacctggcagaagcagacccagcgcagcggcgtgctgtgggacgtgccctccccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggccagcgtgaagaaggacctcatctcctacggcgggggctggcgcctgagcacccagtggcagaagggggaggaggtgcaggtcatcgcggtggagcccggcaagaacccgaagaacttccagaccatgcccggcatcttccagaccacgaccggggagatcggcgccatcgccctggacttcaagcccgggacctccggcagcccgatcatcaaccgggagggcaaggtggtcgggctgtacggcaacggggtggtgaccaagaacggcgggtacgtcagcggcatcgcccagacgaacgcggagcccgacggccccacccccgagctcgaggaggagatgttcaagaagcgcaacctgaccatcatggacctgcacccggggtccggcaagacccggaagtacctccccgccatcgtgcgcgaggccatcaagcggcgcctgcggacgctgatcctcgcccccacccgcgtggtcgccgcggagatggaggaggccctgaaggggctgcccatccggtaccagaccaccgccaccaagagcgagcacaccggccgcgagatcgtggacctcatgtgccacgccaccttcaccatgcggctgctgtccccggtgcgcgtccccaactacaacctcatcatcatggacgaggcccacttcacggaccccgcgagcatcgccgcccgggggtacatctccacccgcgtgggcatgggcgaggccgccgcgatcttcatgaccgccacgccgcccgggacggccgaggccttcccccagagcaacgcgcccatccaggacgaggagcgcgacatccccgagcggtcctggaacagcggcaacgagtggatcaccgacttcgtggggaagaccgtctggttcgtgccctccatcaaggccggcaacgacatcgccaactgcctgcgcaagaacgggaagaaggtgatccagctgagccggaagaccttcgacacggagtaccagaagacccgcctcaacgactgggacttcgtcgtgaccaccgacatctccgagatgggcgccaacttcaaggccgaccgggtgatcgacccccgccggtgcctgaagcccgtcatcctgacggacggccccgagcgcgtgatcctcgcggggccgatgcccgtgaccgccgccagcgccgcccagcggcgcggccgggtcgggcgcaacccccagaaggagaacgaccagtacatcttcaccggccagcccctgaacaacgacgaggaccacgcgcactggaccgaggccaagatgctgctcgacaacatcaacaccccggaggggatcatccccgccctgttcgagcccgagcgggagaagtccgccgccatcgacggcgagtaccgcctgaagggcgagagccggaagacgttcgtggagctcatgcgccgcggggacctgcccgtctggctggcgcacaaggtggcctccgagggcatcaagtacaccgaccgcaagtggtgcttcgacggggagcggaacaaccagatcctcgaggagaacatggacgtggagatctggaccaaggagggcgagcgcaagaagctgcgcccgcggtggctggacgcccgcacctacagcgaccccctcgccctgaaggagttcaaggacttcgcggccggccggaagtccatcgccatcgacctggtcacggagatcgggcgcgtgcccagccacctcgcccaccggacccgcaacgccctggacaacctggtgatgctccacacctccgagcacggcgggcgggcgtaccgccacgccgtcgaggagctgccggagaccatggagacgctgctcctgctgggcctcatgatcctgctgaccgggggcgccatgctgttcctggtgagcggcaaggggatcggcaagaccaccatcgggctgatctgcgtgatcgtcagctccggcatgctctggatggccgacatccccctgcagtggatcgccagcgcgatcgtgctggagttcttcatgatggtgctcctgatccccgagcccgagaagcagcggacgccgcaggacaaccagctggcctacgtcgtgatcgggatcctcaccctggccgccatcgtggccgcgaacgagatgggcctgctcgagaccaccaagcgcgacctgggcatgtccaaggagcccggggtcgtgagccccacgtcctacctggacgtggacctccaccccgccagcgcctggaccctgtacgccgtcgccaccaccgtgatcacgccgatgctgcggcacaccatcgagaactccaccgcgaacgtgagcctcgccgccatcgccaaccaggcggtcgtgctgatgggcctggacaaggggtggcccatctccaagatggacctcggcgtgcccctgctggccctcgggtgctacagccaggtcaaccccctgaccctgacggccgccgtgctcctgctggtgacccactacgccatcatcggcccgggcctccaggcgaaggccacccgcgaggcccagaagcggaccgccgccgggatcatgaagaaccccacggtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgaccctggccacgggccccatcaccaccctctgggagggctccccggggaagttctggaacaccacgatcgccgtgagcatggcgaacatcttccggggctcctacctggccggggccggcctggccttcagcatcatgaagtccgtcgggaccggccgccggggcaccgggagccagggcgagaccctcggggagaagtggaagaagaagctgaaccagctgtcccgcaaggagttcgacctctacaagaagtccggcatcaccgaggtggaccggacggaggcgaaggaggggctgaagcgcggcgagaccacccaccacgccgtgagccggggctccgccaagctgcagtggttcgtcgagcgcaacatggtgatccccgaggggcgcgtgatcgacctcggctgcgggcggggcgggtggagctactactgcgccggcctgaagaaggtcaccgaggtgcgcggctacacgaagggcgggcccgggcacgaggagcccgtgccgatgtccacctacggctggaacatcgtcaagctgatgagcgggaaggacgtgttctacctgccgcccgagaagtgcgacaccctgctgtgcgacatcggcgagtccagcccctccccgaccgtggaggagagccggacgatccgcgtcctgaagatggtggagccctggctcaagaacaaccagttctgcatcaaggtgctgaacccctacatgcccaccgtcatcgagcacctggagcggctccagcgcaagtacggcgggatgctggtgcggaacccgctgtcccgcaacagcacccacgagatgtactggatctccaacggcaccgggaacatcgtgagctccgtcaacatggtgagccggctcctgctgaaccgcttcacgatgacccaccggcgccccaccatcgagaaggacgtcgacctcggcgccggcacccggcacgtgaacgcggagcccgagacgccgaacatggacgtgatcggggagcgcatcaagcggatcaaggaggagcactccagcacctggcactacgacgacgagaacccctacaagacctgggcctaccacggctcctacgaggtcaaggccaccgggagcgcctccagcatgatcaacggcgtggtgaagctgctgacgaagccctgggacgtcgtgcccatggtgacccagatggccatgaccgacaccacgccgttcgggcagcagcgcgtcttcaaggagaaggtggacacccggacgccccggcccatgcccggcacccggaaggtgatggagatcacggcggagtggctctggcgcaccctgggccgcaacaagaagccgcggctgtgcacccgcgaggagttcaccaagaaggtccggacgaacgccgccatgggggccgtgttcaccgaggagaaccagtgggacagcgcccgcgcggccgtggaggacgaggagttctggaagctcgtcgaccgggagcgcgagctgcacaagctgggcaagtgcgggtcctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgagaacagctactccggggtggagggcgaggggctgcacaagctcggctacatcctgcgggacatcagcaagatccccggcggggccatgtacgccgacgacaccgccggctgggacacccgcatcacggaggacgacctgcacaacgaggagaagatcacccagcagatggaccccgagcaccggcagctcgcgaacgccatcttcaagctgacctaccagaacaaggtcgtgaaggtgcagcgccccaccccgaaggggaccgtcatggacatcatctcccggaaggaccagcgcggcagcggccaggtggggacgtacggcctgaacaccttcaccaacatggaggcccagctcgtgcggcagatggagggggagggcgtcctgtccaagaccgacctggagaacccccacctcctggagaagaagatcacgcagtggctggagaacaagggggtggagcgcctcaagcggatggccatcagcggcgacgactgcgtggtcaagcccatcgacgaccgcttcgccaacgcgctgctggccctcaacgacatgggcaaggtgcggaaggacatcccccagtggcagccgtccaaggggtggcacgactggcagcaggtccccttctgcagccaccacttccacgagctgatcatgaaggacggccgcaagctggtcgtgccctgccgcccccaggacgagctcatcgggcgggcccgcatctcccagggcgccgggtggagcctgaaggagaccgcctgcctgggcaaggcgtacgcccagatgtggtccctcatgtacttccaccggcgcgacctgcggctggccagcaacgccatctgctccgccgtgccggtccactgggtgcccaccagccgcaccacgtggtccatccacgcgcaccaccagtggatgaccaccgaggacatgctcaccgtgtggaaccgggtctggatcgaggacaacccctggatggaggacaagacgcccgtgaccacctgggaggacgtgccgtacctgggcaagcgcgaggaccagtggtgcgggagcctgatcggcctcaccagccgggccacgtgggcccagaacatcctgaccgccatccagcaggtccgctccctgatcggggacgaggagttcctcgactacatgcccagcatgaagcggttccgcaaggaggaggagtccgagggcgcgatctggtga

SEQ ID NO: 9961 - RNA, 9873 nt, synthetic construct
  misc_feature 1..9873: note = derived and/or modified CDS sequence (opt1) from DENV-3__GQ868626__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgaccgggatcaacatgtgcaccctcatcgccatggacctgggcgagatgtgcgacgacacggtgacctacaagtgccccctgatcgccgaggtggagcccgaggacatcgactgctggtgcaacctcacctccacctgggtgacgtacgggacctgcaaccaggccggcgagcaccggcgcgacaagcggagcgtggccctggcgccccacgtgggcatggggctggacacccgcacccagacgtggatgtccgccgagggcgcctggcgccaggtggagaaggtcgagacctgggccctccgccacccggggttcaccatcctggcgctgttcctcgcccactacatcggcaccagcctgatccagaaggtggtgatcttcatcctgctcatgctggtcacgccctccatgaccatgcggtgcgtgggggtgggcaaccgcgacttcgtcgagggcctgagcggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgactcccgctgccccacgcagggcgaggccatcctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggcctccaccgtggaggccgtgctgcccgagtacggcaccctcgggctggagtgcagcccgcgcaccggcctggacttcaacgagatgatcctcctgaccatgaagaacaaggcgtggatggtccaccggcagtggttcttcgacctgcccctcccctggacgtccggcgccaccatcgagacccccacctggaaccgcaaggagctgctggtgacgttcaagaacgcccacgccaagaagcaggaggtggtcgtgctcgggagccaggagggcgccatgcacaccgcgctgaccggggccaccgagatccagaactccggcgggacgagcatcttcgccggccacctgaagtgccggctcaagatggacaagctggagctgaagggcatgtcctacgccatgtgcctcaacaccttcgtgctgcgcaaggaggtcagcgagacccagcacgggaccatcctgatcaaggtggagtacaagggcgaggacgccccgtgcaagatccccttctccacggaggacgggcagggcaaggcgcacaacggccggctgatcaccgccaaccccgtggtcaccaagaaggaggagcccgtgaacatcgaggccgagccgcccttcggggagagcaacatcgtgatcggcatcggggacaaggccctcaagatcaactggtacaagaagggcagctccatcgggaagatgttcgaggcgaccgcccgcggcgcccggcgcatggccatcctgggcgacacggcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacaccagcatgtccttcagctgcatcgtgatcgggatcatcacgctgtacctcggcgccgtcgtgcaggccgacatggggtgcgtgatcaactggaagggcaaggagctgaagtgcggctccgggatcttcgtcaccaacgaggtgcacacctggaccgagcagtacaagttccaggccgacagccccaagcgcctggcgacggccatcgccggcgcctgggagaacggggtgtgcggcatccggtccaccacccgcatggagaacctcctgtggaagcagatcgccaacgagctgaactacatcctctgggagaacaacatcaagctgaccgtcgtggtgggggacatcatcggcgtcctggagcagggcaagcggacgctcacgccccagccgatggagctgaagtacagctggaagacctgggggaaggcgaagatcgtgaccgccgagacgcagaactccagcttcatcatcgacggccccaacacccccgagtgcccctccgccagccgcgcctggaacgtgtgggaggtcgaggactacgggttcggcgtgttcaccaccaacatctggctgaagctccgggaggtgtacacgcagtcctgcgaccaccgcctgatgagcgcggccatcaaggacgagcgggccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatcaacgagaaggaggagaacatggtcaagtccctggtgagcgccggctccgggaaggtggacaacttcaccatgggcgtcctgtgcctcgccatcctgttcgaggaggtgatgcgcgggaagttcggcaagaagcacatgatcgccggggtgctgttcaccttcgtcctcctgctgagcggccagatcacctggcgggacatggcgcacacgctcatcatgatcggctccaacgccagcgaccgcatggggatgggcgtgacctacctggccctgatcgccaccttcaagatccagcccttcctcgccctggggttcttcctgcggaagctcacctcccgcgagaacctgctgctcggcgtgggcctggcgatggccacgaccctgcagctccccgaggacatcgagcagatggccaacgggatcgccctgggcctgatgaccctcaagctgatcacccagttcgagacgtaccagctgtggaccgcgctcgtcagcctgacctgcagcaacaccatcttcacgctgaccgtggcctggcggaccgccaccctcatcctggccggggtctccctgctcccgctgtgccagagctccagcatgcgcaagacggactggctgcccatgaccgtggccgcgatgggcgtgccgcccctgccgctgttcatcttctccctgaaggacacccccaagcgccggagctggcccctcaacgagggggtcatggccgtgggcctggtgtccatcctggccagctccctcctgcgcaacgacgtccccatggccggcccgctggtggccgggggcctcctgatcgcgtgctacgtgatcaccgggacgagcgccgacctgaccgtcgagaaggccgccgacgtgacctgggaggaggaggccgagcagaccggcgtgtcccacaacctcatgatcacggtcgacgacgacgggaccatgcggatcaaggacgacgagaccgagaacatcctgaccgtgctgctcaagaccgcgctgctgatcgtgagcggcatcttcccctactccatccccgccacgctcctggtctggcacacctggcagaagcagacccagcgcagcggcgtgctgtgggacgtgccctccccgcccgagacccagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacccacaacgggaagcggctggagcccaactgggccagcgtgaagaaggacctcatctcctacggcgggggctggcgcctgagcacgcagtggcagaagggggaggaggtgcaggtcatcgcggtggagcccggcaagaacccgaagaacttccagaccatgcccggcatcttccagaccaccacgggggagatcggcgccatcgccctggacttcaagcccgggacctccggcagcccgatcatcaaccgggagggcaaggtggtcgggctgtacggcaacggggtggtgaccaagaacggcgggtacgtcagcggcatcgcccagaccaacgcggagcccgacggccccacgcccgagctcgaggaggagatgttcaagaagcgcaacctgaccatcatggacctgcacccggggtccggcaagacccggaagtacctccccgccatcgtgcgcgaggccatcaagcggcgcctgcggaccctgatcctcgcccccacgcgcgtggtcgccgcggagatggaggaggccctgaaggggctgcccatccggtaccagaccaccgccaccaagagcgagcacacgggccgcgagatcgtggacctcatgtgccacgccaccttcaccatgcggctgctgtccccggtgcgcgtccccaactacaacctcatcatcatggacgaggcccacttcaccgaccccgcgagcatcgccgcccgggggtacatctccacgcgcgtgggcatgggcgaggccgccgcgatcttcatgaccgccacgccgcccgggaccgccgaggccttcccccagagcaacgcgcccatccaggacgaggagcgcgacatccccgagcggtcctggaacagcggcaacgagtggatcacggacttcgtggggaagaccgtctggttcgtgccctccatcaaggccggcaacgacatcgccaactgcctgcgcaagaacgggaagaaggtgatccagctgagccggaagaccttcgacaccgagtaccagaagacgcgcctcaacgactgggacttcgtcgtgaccaccgacatctccgagatgggcgccaacttcaaggccgaccgggtgatcgacccccgccggtgcctgaagcccgtcatcctgaccgacggccccgagcgcgtgatcctcgcggggccgatgcccgtgacggccgccagcgccgcccagcggcgcggccgggtcgggcgcaacccccagaaggagaacgaccagtacatcttcaccggccagcccctgaacaacgacgaggaccacgcgcactggaccgaggccaagatgctgctcgacaacatcaacaccccggaggggatcatccccgccctgttcgagcccgagcgggagaagtccgccgccatcgacggcgagtaccgcctgaagggcgagagccggaagaccttcgtggagctcatgcgccgcggggacctgcccgtctggctggcgtacaaggtggcctccgagggcatcaagtacacggaccgcaagtggtgcttcgacggggagcggaacaaccagatcctcgaggagaacatggacgtggagatctggaccaaggagggcgagcgcaagaagctgcgcccgcggtggctggacgcccgcacctacagcgaccccctcgccctgaaggagttcaaggacttcgcggccggccggaagtccatcgccctggacctcgtcaccgagatcgggcgcgtgcccagccacctggcccaccggacgcgcaacgccctggacaacctcgtgatgctgcacacctccgagcacggcgggcgggcgtaccgccacgccgtcgaggagctgccggagaccatggagaccctcctgctgctcggcctgatgatcctgctcaccggcggggccatgctgttcctgatcagcgggaaggggatcggcaagaccaccatcgggctcatctgcgtgatcgtgagctccggcatgctgtggatggccgacatccccctgcagtggatcgccagcgcgatcgtcctcgagttcttcatgatggtgctgctgatccccgagcccgagaagcagcggaccccgcaggacaaccagctcgcctacgtggtcatcgggatcctgacgctggccgccatcgtggccgcgaacgagatgggcctcctggagaccaccaagcgcgacctgggcatgtccaaggagcccggggtggtcagccccacctcctacctcgacgtggacctgcaccccgccagcgcctggacgctgtacgccgtggccaccaccgtcatcaccccgatgctccggcacacgatcgagaactccaccgcgaacgtgagcctggccgccatcgccaaccaggcggtggtcctgatgggcctcgacaaggggtggcccatctccaagatggacctgggcgtgcccctgctcgccctggggtgctacagccaggtgaaccccctgaccctcaccgccgccgtcctgctgctcgtgacgcactacgccatcatcggcccgggcctgcaggcgaaggccacccgcgaggcccagaagcggaccgccgccgggatcatgaagaaccccaccgtggacggcatcatgacgatcgacctggaccccgtcatctacgactccaagttcgagaagcagctcggccaggtgatgctgctggtgctctgcgcggtccagctgctgctcatgcgcaccagctgggccctgtgcgaggccctgaccctcgccaccggccccatcacgaccctgtgggagggctccccggggaagttctggaacaccaccatcgccgtgagcatggcgaacatcttccggggctcctacctggccggggccggcctcgccttcagcatcatgaagtccgtggggacgggccgccggggcaccgggagccagggcgagaccctgggggagaagtggaagaagaagctgaaccagctctcccgcaaggagttcgacctgtacaagaagtccggcatcaccgaggtcgaccggaccgaggcgaaggaggggctgaagcgcggcgagacgacccaccacgccgtgagccggggctccgccaagctccagtggttcgtggagcgcaacatggtcatccccgaggggcgcgtgatcgacctgggctgcgggcggggcgggtggagctactactgcgccggcctgaagaaggtgaccgaggtccgcggctacaccaagggcgggcccgggcacgaggagcccgtgccgatgtccacgtacggctggaacatcgtgaagctcatgagcgggaaggacgtcttctacctgccgcccgagaagtgcgacaccctgctgtgcgacatcggcgagtccagcccctccccgaccgtggaggagagccggaccatccgcgtgctcaagatggtcgagccctggctgaagaacaaccagttctgcatcaaggtgctgaacccctacatgcccacggtgatcgagcacctcgagcggctgcagcgcaagtacggcgggatgctggtccggaacccgctctcccgcaacagcacccacgagatgtactggatctccaacggcaccgggaacatcgtgagctccgtgaacatggtcagccggctgctgctcaaccgcttcaccatgacgcaccggcgccccaccatcgagaaggacgtggacctgggcgccggcacccggcacgtcaacgcggagcccgagaccccgaacatggacgtgatcggggagcgcatcaagcggatcaaggaggagcactccagcacgtggcactacgacgacgagaacccctacaagacctgggcctaccacggctcctacgaggtgaaggccaccgggagcgcctccagcatgatcaacggcgtcgtgaagctgctcaccaagccctgggacgtggtccccatggtgacgcagatggccatgaccgacaccaccccgttcgggcagcagcgcgtgttcaaggagaaggtcgacacgcggacgccccggcccatgcccggcacccggaaggtgatggagatcaccgcggagtggctgtggcgcacgctgggccgcaacaagaagccgcggctctgcacccgcgaggagttcaccaagaaggtgcggaccaacgccgccatgggggccgtcttcacggaggagaaccagtgggacagcgcccgcgcggccgtggaggacgaggagttctggaagctggtggaccgggagcgcgagctgcacaagctcggcaagtgcgggtcctgcgtctacaacatgatgggcaagcgggagaagaagctgggggagttcggcaaggccaagggcagccgcgccatctggtacatgtggctgggggcgcggttcctcgagttcgaggccctgggcttcctgaacgaggaccactggttctcccgcgagaacagctactccggggtggagggcgaggggctccacaagctgggctacatcctgcgggacatcagcaagatccccggcggggccatgtacgccgacgacaccgccggctgggacacccgcatcaccgaggacgacctccacaacgaggagaagatcacgcagcagatggaccccgagcaccggcagctggcgaacgccatcttcaagctgacctaccagaacaaggtggtcaaggtgcagcgccccaccccgaaggggaccgtgatggacatcatctcccggaaggaccagcgcggcagcggccaggtcgggacctacggcctcaacacgttcaccaacatggaggcccagctggtgcggcagatggagggggagggcgtgctgtccaaggccgacctcgagaacccccacctcctggagaagaagatcacccagtggctcgagaacaagggggtcgagcgcctgaagcggatggccatcagcggcgacgactgcgtggtgaagcccatcgacgaccgcttcgcgaacgccctgctcgccctgaacgacatgggcaaggtccggaaggacatcccccagtggcagccgtccaaggggtggcacgactggcagcaggtccccttctgcagccaccacttccacgagctgatcatgaaggacggccgcaagctcgtggtcccctgccgcccccaggacgagctgatcgggcgggcccgcatctcccagggcgccgggtggagcctgaaggagaccgcgtgcctcggcaaggcctacgcccagatgtggtccctgatgtacttccaccggcgcgacctgcggctcgccagcaacgccatctgctccgcggtgccggtgcactgggtccccacgagccgcaccacctggtccatccacgcccaccaccagtggatgaccacggaggacatgctggccgtgtggaaccgggtgtggatcgaggacaacccctggatggaggacaagacccccgtcaccacctgggaggacgtgccgtacctgggcaagcgcgaggaccagtggtgcgggagcctcatcggcctgacgagccgggccacctgggcgcagaacatcctgaccgccatccagcaggtccgctccctcatcggggacgaggagttcctggactacatgcccagcatgaagcggttccgcaaggaggaggagtccgagggcgccatctggtga

SEQ ID NO: 9962 - RNA, 9873 nt, synthetic construct
  misc_feature 1..9873: note = derived and/or modified CDS sequence (opt1) from DENV-3__GQ868627__SS-prME
  source 1..9873: mol_type = other RNA
accagcctgtgcctcatgatgatgctgcccgccaccctggccttccacctcaccagccgggacggggagccccggatgatcgtggggaagaacgagcgcggcaagagcctgctgttcaagaccgcgaccgggatcaacatgtgcaccctcatcgccatggacctgggcgagatgtgcgacgacaccgtgacctacaagtgccccctgatcgccgaggtggagcccgaggacatcgactgctggtgcaacctcacctccacctgggtgacgtacgggacctgcaaccaggccggcgagcaccggcgcgacaagcggagcgtggccctggcgccccacgtgggcatggggctggacacccgcacccagacgtggatgtccgccgagggcgcctggcgccaggtggagaaggtcgagacctgggccctccgccacccggggttcaccatcctggcgctgttcctcgcccactacatcggcaccagcctgatccagaaggtggtgatcttcatcctgctcatgctggtcacgccctccatgaccatgcggtgcgtgggggtgggcaaccgcgacttcgtcgagggcctgagcggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgactcccgctgccccacgcagggcgaggccatcctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggcctccaccgtggaggccgtgctgcccgagtacggcaccctcgggctggagtgcagcccgcgcaccggcctggacttcaacgagatgatcctcctgaccatgaagaacaaggcgtggatggtccaccggcagtggttcttcgacctgcccctcccctggacgtccggcgccaccaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgcgcaaggaggtcagcgagacccagcacgggacgatcctgatcaaggtggagtacaagggcgaggacgccccgtgcaagatccccttctccaccgaggacgggcagggcaaggcgcacaacggccggctgatcaccgccaaccccgtggtcaccaagaaggaggagcccgtgaacatcgaggccgagccgcccttcggggagagcaacatcgtgatcggcatcggggacaaggccctcaagatcaactggtacaagaagggcagctccatcgggaagatgttcgaggcgacggcccgcggcgcccggcgcatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacctggacggagcagtacaagttccaggccgacagccccaagcgcctggcgaccgccatcgccggcgcctgggagaacggggtgtgcggcatccggtccaccacccgcatggagaacctcctgtggaagcagatcgccaacgagctgaactacatcctctgggagaacaacatcaagctgacggtcgtggtgggggacatcatcggcgtcctggagcagggcaagcggaccctcacgccccagccgatggagctgaagtacagctggaagacctgggggaaggcgaagatcgtgacggccgagacccagaactccagcttcatcatcgacggccccaacacccccgagtgcccctccgccagccgcgcctggaacgtgtgggaggtcgaggactacgggttcggcgtgttcaccacgaacatctggctgaagctccgggaggtgtacacccagtcctgcgaccaccgcctgatgagcgcggccatcaaggacgagcgggccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccgcccgggctaccacacgcagaccgccgggccctggcacctcggcaagctggagctggacttcaactactgcgagggcaccaccgtcgtgatcacggagaactgcgggacccggggccccagcctccgcaccaccacggtgtccgggaagctgatccacgagtggtgctgccggagctgcaccctgcccccgctccgctacatgggcgaggacgggtgctggtacggcatggagatccggcccatcaacgagaaggaggagaacatggtcaagtccctggtgagcgccggctccgggaaggtggacaacttcaccatgggcgtcctgtgcctcgccatcctgttcgaggaggtgatgcgcgggaagttcggcaagaagcacatgatcgccggggtgctgttcaccttcgtcctcctgctgagcggccagatcacgtggcgggacatggcgcacaccctcatcatgatcggctccaacgccagcgaccgcatggggatgggcgtgacctacctggccctgatcgccaccttcaagatccagcccttcctcgccctggggttcttcctgcggaagctcacgtcccgcgagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgcagcaacacgatcttcaccctgaccgtggcctggcggaccgccacgctcatcctggccggggtctccctgctcccgctgtgccagagctccagcatgcgcaagaccgactggctgcccatgaccgtggccgcgatgggcgtgccgcccctgccgctgttcatcttctccctgaaggacacccccaagcgccggagctggcccctcaacgagggggtcatggccgtgggcctggtgtccatcctggccagctccctcctgcgcaacgacgtccccatggccggcccgctggtggccgggggcctcctgatcgcgtgctacgtgatcacggggaccagcgccgacctgaccgtcgagaaggccgccgacgtgacctgggaggaggaggccgagcagacgggcgtgtcccacaacctcatgatcaccgtcgacgacgacgggaccatgcggatcaaggacgacgagaccgagaacatcctgaccgtgctgctcaagacggcgctgctgatcgtgagcggcatcttcccctactccatccccgccaccctcctggtctggcacacctggcagaagcagacccagcgcagcggcgtgctgtgggacgtgccctccccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggccagcgtgaagaaggacctcatctcctacggcgggggctggcgcctgagcacccagtggcagaagggggaggaggtgcaggtcatcgcggtggagcccggcaagaacccgaagaacttccagaccatgcccggcatcttccagaccacgaccggggagatcggcgccatcgccctggacttcaagcccgggacctccggcagcccgatcatcaaccgggagggcaaggtggtcgggctgtacggcaacggggtggtgaccaagaacggcgggtacgtcagcggcatcgcccagacgaacgcggagcccgacggccccacccccgagctcgaggaggagatgttcaagaagcgcaacctgaccatcatggacctgcacccggggtccggcaagacccggaagtacctccccgccatcgtgcgcgaggccatcaagcggcgcctgcggacgctgatcctcgcccccacccgcgtggtcgccgcggagatggaggaggccctgaaggggctgcccatccggtaccagaccaccgccaccaagagcgagcacaccggccgcgagatcgtggacctcatgtgccacgccaccttcaccatgcggctgctgtccccggtgcgcgtccccaactacaacctcatcatcatggacgaggcccacttcacggaccccgcgagcatcgccgcccgggggtacatctccacccgcgtgggcatgggcgaggccgccgcgatcttcatgaccgccacgccgcccgggacggccgaggccttcccccagagcaacgcgcccatccaggacgaggagcgcgacatccccgagcggtcctggaacagcggcaacgagtggatcaccgacttcgtggggaagaccgtctggttcgtgccctccatcaaggccggcaacgacatcgccaactgcctgcgcaagaacgggaagaaggtgatccagctgagccggaagaccttcgacacggagtaccagaagacccgcctcaacgactgggacttcgtcgtgaccaccgacatctccgagatgggcgccaacttcaaggccgaccgggtgatcgacccccgccggtgcctgaagcccgtcatcctgacggacggccccgagcgcgtgatcctcgcggggccgatgcccgtgaccgccgccagcgccgcccagcggcgcggccgggtcgggcgcaacccccagaaggagaacgaccagtacatcttcaccggccagcccctgaacaacgacgaggaccacgcgcactggaccgaggccaagatgctgctcgacaacatcaacaccccggaggggatcatccccgccctgttcgagcccgagcgggagaagtccgccgccatcgacggcgagtaccgcctgaagggcgagagccggaagacgttcgtggagctcatgcgccgcggggacctgcccgtctggctggcgtacaaggtggcctccgagggcatcaagtacaccgaccgcaagtggtgcttcgacggggagcggaacaaccagatcctcgaggagaacatggacgtggagatctggaccaaggagggcgagcgcaagaagctgcgcccgcggtggctggacgcccgcacctacagcgaccccctcgccctgaaggagttcaaggacttcgcggccggccggaagtccatcgccctggacctcgtcacggagatcgggcgcgtgcccagccacctggcccaccggacccgcaacgccctggacaacctcgtgatgctgcacacctccgagcacggcgggcgggcgtaccgccacgccgtcgaggagctgccggagaccatggagacgctcctgctgctcggcctgatgatcctgctcaccgggggcgccatgctgttcctgatcagcggcaaggggatcggcaagaccaccatcgggctcatctgcgtgatcgtgagctccggcatgctgtggatggccgacatccccctgcagtggatcgccagcgcgatcgtcctcgagttcttcatgatggtgctgctgatccccgagcccgagaagcagcggacgccgcaggacaaccagctcgcctacgtggtcatcgggatcctgaccctggccgccatcgtggccgcgaacgagatgggcctcctggagaccaccaagcgcgacctgggcatgtccaaggagcccggggtggtcagccccacgtcctacctcgacgtggacctgcaccccgccagcgcctggaccctgtacgccgtggccaccaccgtcatcacgccgatgctccggcacaccatcgagaactccaccgcgaacgtgagcctggccgccatcgccaaccaggcggtggtcctgatgggcctcgacaaggggtggcccatctccaagatggacctgggcgtgcccctgctcgccctggggtgctacagccaggtgaaccccctgaccctcacggccgccgtcctgctgctcgtgacccactacgccatcatcggcccgggcctgcaggcgaaggccacccgcgaggcccagaagcggaccgccgccgggatcatgaagaaccccacggtggacggcatcatgaccatcgacctggaccccgtcatctacgactccaagttcgagaagcagctcggccaggtgatgctgctggtgctctgcgcggtccagctgctgctcatgcgcaccagctgggccctgtgcgaggccctgaccctcgccacgggccccatcaccaccctgtgggagggctccccggggaagttctggaacaccacgatcgccgtgagcatggcgaacatcttccggggctcctacctggccggggccggcctcgccttcagcatcatgaagtccgtggggaccggccgccggggcaccgggagccagggcgagaccctgggggagaagtggaagaagaagctgaaccagctctcccgcaaggagttcgacctgtacaagaagtccggcatcaccgaggtcgaccggacggaggcgaaggaggggctgaagcgcggcgagaccacccaccacgccgtgagccggggctccgccaagctccagtggttcgtggagcgcaacatggtcatccccgaggggcgcgtgatcgacctgggctgcgggcggggcgggtggagctactactgcgccggcctgaagaaggtgaccgaggtccgcggctacacgaagggcgggcccgggcacgaggagcccgtgccgatgtccacctacggctggaacatcgtgaagctcatgagcgggaaggacgtcttctacctgccgcccgagaagtgcgacaccctgctgtgcgacatcggcgagtccagcccctccccgaccgtggaggagagccggacgatccgcgtgctcaagatggtcgagccctggctgaagaacaaccagttctgcatcaaggtgctgaacccctacatgcccaccgtgatcgagcacctcgagcggctgcagcgcaagtacggcgggatgctggtccggaacccgctctcccgcaacagcacccacgagatgtactggatctccaacggcaccgggaacatcgtgagctccgtgaacatggtcagccggctgctgctcaaccgcttcacgatgacccaccggcgccccaccatcgagaaggacgtggacctgggcgccggcacccggcacgtcaacgcggagcccgagacgccgaacatggacgtgatcggggagcgcatcaagcggatcaaggaggagcactccagcacctggcactacgacgacgagaacccctacaagacctgggcctaccacggctcctacgaggtgaaggccaccgggagcgcctccagcatgatcaacggcgtcgtgaagctgctcacgaagccctgggacgtggtccccatggtgacccagatggccatgaccgacaccacgccgttcgggcagcagcgcgtgttcaaggagaaggtcgacacccggacgccccggcccatgcccggcacccggaaggtgatggagatcacggcggagtggctgtggcgcaccctgggccgcaacaagaagccgcggctctgcacccgcgaggagttcaccaagaaggtgcggacgaacgccgccatgggggccgtcttcaccgaggagaaccagtgggacagcgcccgcgcggccgtggaggacgaggagttctggaagctggtggaccgggagcgcgagctgcacaagctcggcaagtgcgggtcctgcgtctacaacatgatgggcaagcgggagaagaagctgggggagttcggcaaggccaagggcagccgcgccatctggtacatgtggctgggggcgcggttcctcgagttcgaggccctgggcttcctgaacgaggaccactggttctcccgcgagaacagctactccggggtggagggcgaggggctccacaagctgggctacatcctgcgggacatcagcaagatccccggcggggccatgtacgccgacgacaccgccggctgggacacccgcatcacggaggacgacctccacaacgaggagaagatcacccagcagatggaccccgagcaccggcagctggcgaacgccatcttcaagctgacctaccagaacaaggtggtcaaggtgcagcgccccaccccgaaggggaccgtgatggacatcatctcccggaaggaccagcgcggcagcggccaggtcgggacgtacggcctcaacaccttcaccaacatggaggcccagctggtgcggcagatggagggggagggcgtgctgtccaaggccgacctcgagaacccccacctcctggagaagaagatcacccagtggctcgagaacaagggggtcgagcgcctgaagcggatggccatcagcggcgacgactgcgtggtgaagcccatcgacgaccgcttcgcgaacgccctgctcgccctgaacgacatgggcaaggtccggaaggacatcccccagtggcagccgtccaaggggtggcacgactggcagcaggtccccttctgcagccaccacttccacgagctgatcatgaaggacggccgcaagctcgtggtcccctgccgcccccaggacgagctgatcgggcgggcccgcatctcccagggcgccgggtggagcctgaaggagacggcgtgcctcggcaaggcctacgcccagatgtggtccctgatgtacttccaccggcgcgacctgcggctcgccagcaacgccatctgctccgcggtgccggtgcactgggtccccaccagccgcaccacctggtccatccacgcccaccaccagtggatgacgaccgaggacatgctggccgtgtggaaccgggtgtggatcgaggacaacccctggatggaggacaagacccccgtcaccacgtgggaggacgtgccgtacctgggcaagcgcgaggaccagtggtgcgggagcctcatcggcctgaccagccgggccacctgggcgcagaacatcctgaccgccatccagcaggtccgctccctcatcggggacgaggagttcctggactacatgcccagcatgaagcggttccgcaaggaggaggagtccgagggcgccatctggtga

SEQ ID NO: 9963 - RNA, 9873 nt, synthetic construct
  misc_feature 1..9873: note = derived and/or modified CDS sequence (opt1) from DENV-3__FJ639721__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgccaccgggatcaacatgtgcaccctcatcgccatggacctgggcgagatgtgcgacgacaccgtcacctacaagtgccccctgatcgtggaggtggagcccgaggacatcgactgctggtgcaacctcacctccacctgggtcacgtacgggacctgcaaccaggccggcgagcaccggcgcgacaagcggagcgtggccctggcgccccacgtgggcatggggctggacacccgcacccagacgtggatgtccgcggagggcgcctggcggcaggtcgagaaggtggagacctgggccctccgccacccggggttcaccatcctggccctgttcctcgcgcactacatcggcaccagcctgatccagaaggtggtcatcttcatcctgctcatgctggtgacgccctccatgaccatgcggtgcgtgggggtcggcaaccgcgacttcgtggagggcctgagcggggccacctgggtggacgtcgtgctcgagcacggcgggtgcgtgaccacgatggccaagaacaagcccaccctggacatcgagctgcagaagaccgaggccacccagctcgccacgctgcggaagctgtgcatcgagggcaagatcaccaacatcaccaccgactcccgctgccccacgcagggcgaggcgatcctcccggaggagcaggaccagaactacgtctgcaagcacacctacgtggaccgggggtggggcaacgggtgcggcctgttcgggaagggcagcctggtgacctgcgccaagttccagtgcctcgagcccatcgagggcaaggtcgtgcagtacgagaacctgaagtacaccgtgatcatcacggtccacaccggggaccagcaccaggtgggcaacgacacccagggggtcaccgtggagatcacgccccaggcctccaccgtggaggccgtcctgcccgagtacggcaccctcgggctggagtgcagcccgcgcaccggcctggacttcaacgagatgatcctcctgaccatgaagaacaaggcctggatggtgcaccggcagtggttcttcgacctgcccctcccctggacgtccggcgcgaccaccgagacccccacgtggaaccgcaaggagctgctggtgaccttcaagaacgcccacgccaagaagcaggaggtcgtggtgctcgggagccaggagggcgccatgcacaccgccctgaccggggcgacggagatccagaactccggcgggaccagcatcttcgccggccacctgaagtgccggctcaagatggacaagctggagctgaagggcatgtcctacgccatgtgcctcaacaccttcgtcctgaagaaggaggtgagcgagacccagcacgggacgatcctgatcaaggtggagtacaagggcgaggacgccccgtgcaagatccccttctccaccgaggacgggcagggcaaggcccacaacggccgcctgatcaccgcgaaccccgtcgtgaccaagaaggaggagcccgtgaacatcgaggccgagccgcccttcggggagagcaacatcgtcatcggcatcggggacaaggccctcaagatcaactggtacaagaagggcagctccatcgggaagatgttcgaggccacggcgcggggcgcccgccggatggccatcctgggcgacaccgcctgggacttcgggagcgtgggcggggtgctgaactccctcggcaagatggtccaccagatcttcgggagcgcctacaccgcgctgttctccggcgtgagctggatcatgaagatcggcatcggggtgctgctcacctggatcggcctgaactccaagaacacgagcatgtccttcagctgcatcgtcatcgggatcatcaccctgtacctcggcgccgtggtgcaggccgacatggggtgcgtcatcaactggaagggcaaggagctgaagtgcggctccgggatcttcgtgaccaacgaggtgcacacctggacggagcagtacaagttccaggccgacagccccaagcgcctggccaccgcgatcgccggcgcctgggagaacggggtctgcggcatccgctccaccacccggatggagaacctcctgtggaagcagatcgccaacgagctgaactacatcctctgggagaacaacatcaagctgacggtggtggtcggggacatcatcggcgtgctggagcagggcaagcgcaccctcacgccccagccgatggagctgaagtacagctggaagacctgggggaaggccaagatcgtgacggcggagacccagaactccagcttcatcatcgacggccccaacacccccgagtgcccctccgccagccgggcctggaacgtctgggaggtggaggactacgggttcggcgtgttcaccacgaacatctggctgaagctccgcgaggtctacacccagtcctgcgaccaccggctgatgagcgccgcgatcaaggacgagcgcgccgtgcacgccgacatgggctactggatcgagagccagaagaacgggtcctggaagctggagaaggccagcttcatcgaggtgaagacctgcacctggccgaagtcccacaccctctggagcaacggcgtcctggagtccgacatgatcatccccaagagcctggccgggcccatctcccagcacaaccaccggccgggctaccacacgcagaccgcggggccctggcacctcggcaagctggagctggacttcaactactgcgagggcaccaccgtggtgatcacggagaactgcgggacccgcggccccagcctccggaccaccacggtctccgggaagctgatccacgagtggtgctgccgcagctgcaccctgcccccgctccggtacatgggcgaggacgggtgctggtacggcatggagatccgccccatcaacgagaaggaggagaacatggtgaagtccctggtgagcgccggctccgggaaggtcgacaacttcaccatgggcgtgctgtgcctcgccatcctgttcgaggaggtgatgcgggggaagttcggcaagaagcacatgatcgccggggtcctgttcaccttcgtgctcctgctgagcggccagatcacgtggcgcgacatggcccacaccctcatcatgatcggctccaacgcgagcgaccggatggggatgggcgtgacctacctggccctgatcgccaccttcaagatccagcccttcctcacgctggggttcttcctgcgcaagctcacctcccgggagaacctgctgctcggcgtcggcctggccatggccaccaccctgcagctccccgaggacatcgagcagatggcgaacgggatcgccctgggcctgatgacgctcaagctgatcacccagttcgagacctaccagctgtggaccgccctcgtgagcctgacgtgcagcaacaccatcttcaccctgaccgtcgcctggcgcacggcgaccctcatcctggccggggtgtccctgctcccgctgtgccagagctccagcatgcggaagaccgactggctgcccatgaccgtggccgccatgggcgtgccgcccctgccgctgttcatcttctccctgaaggacgcccccaagcgccgcagctggcccctcaacgagggggtgatggcggtgggcctggtctccatcctggccagctccctcctgcggaacgacgtgcccatggccggcccgctggtggccgggggcctcctgatcgcctgctacgtcatcacggggaccagcgcggacctgaccgtggagaaggccgccgacgtgacctgggaggaggaggccgagcagacgggcgtctcccacaacctcatgatcaccgtggacgacgacgggaccatgcgcatcaaggacgacgagaccgagaacatcctgaccgtgctgctcaagacggccctgctgatcgtcagcggcatcttcccctactccatccccgcgaccctcctggtgtggcacacctggcagaagcagacccagcggagcggcgtgctgtgggacgtcccctccccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggccagcgtgaagaaggacctcatctcctacggcgggggctggcggctgagcacccagtggcagaagggggaggaggtccaggtgatcgccgtggagcccggcaagaacccgaagaacttccagaccatgcccggcatcttccagaccacgaccggggagatcggcgcgatcgccctggacttcaagcccgggacctccggcagcccgatcatcaaccgcgagggcaaggtcgtggggctgtacggcaacggggtggtcaccaagaacggcgggtacgtgagcggcatcgcccagacgaacgccgagcccgacggccccacccccgagctcgaggaggagatgttcaagaagcggaacctgaccatcatggacctgcacccggggtccggcaagacccgcaagtacctccccgcgatcgtgcgggaggccatcaagcgccggctgcgcacgctgatcctcgcccccacccgggtcgtggccgccgagatggaggaggcgctgaaggggctgcccatccgctaccagaccaccgccaccaagagcgagcacaccggccgggagatcgtggacctcatgtgccacgccaccttcaccatgcgcctgctgtccccggtccgggtgcccaactacaacctcatcatcatggacgaggcccacttcacggaccccgccagcatcgcggcccgcgggtacatctccacccgggtgggcatgggcgaggccgccgccatcttcatgaccgcgacgccgcccgggacggccgaggccttcccccagagcaacgcccccatccaggacgaggagcgcgacatccccgagcgctcctggaacagcggcaacgagtggatcaccgacttcgtcgggaagaccgtgtggttcgtgccctccatcaaggcgggcaacgacatcgccaactgcctgcggaagaacgggaagaaggtcatccagctgagccgcaagaccttcgacacggagtaccagaagacccggctcaacgactgggacttcgtggtgaccaccgacatctccgagatgggcgccaacttcaaggccgaccgcgtcatcgacccccggcgctgcctgaagcccgtgatcctgacggacggccccgagcgggtgatcctcgccgggccgatgcccgtcaccgcggccagcgccgcccagcgccggggccgcgtggggcggaacccccagaaggagaacgaccagtacatcttcaccggccagcccctgaacaacgacgaggaccacgcccactggaccgaggcgaagatgctgctcgacaacatcaacaccccggaggggatcatccccgccctgttcgagcccgagcgcgagaagtccgccgccatcgacggcgagtaccggctgaagggcgagagccgcaagacgttcgtcgagctcatgcggcgcggggacctgcccgtgtggctggcccacaaggtggcgtccgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcccggacctacagcgaccccctcgccctgaaggagttcaaggacttcgccgcgggccgcaagtccatcgccctggacctcgtgacggagatcgggcgggtgcccagccacctggcccaccgcacccggaacgccctggacaacctcgtcatgctgcacacctccgagcacggcgggcgcgcctaccggcacgcggtggaggagctgccggagaccatggagacgctcctgctgctcggcctgatgatcctgctcaccgggggcgccatgctgttcctggtgagcggcaaggggatcggcaagaccaccatcgggctcatctgcgtcatcgtgagctccggcatgctgtggatggccgacatccccctgcagtggatcgccagcgccatcgtgctcgagttcttcatgatggtcctgctgatccccgagcccgagaagcagcgcacgccgcaggacaaccagctcgcgtacgtggtgatcgggatcctgaccctggccgccatcgtcgccgccaacgagatgggcctcctggagaccaccaagcgggacctgggcatgtccaaggagcccggggtggtgagccccacgtcctacctcgacgtcgacctgcaccccgcgagcgcctggaccctgtacgccgtggccaccaccgtgatcacgccgatgctccgccacaccatcgagaactccaccgccaacgtcagcctggcggccatcgccaaccaggccgtggtgctgatgggcctcgacaaggggtggcccatctccaagatggacctgggcgtccccctgctcgcgctggggtgctacagccaggtgaaccccctgaccctcacggccgccgtgctgctgctcgtcacccactacgccatcatcggcccgggcctgcaggccaaggcgacccgggaggcccagaagcgcaccgccgccgggatcatgaagaaccccacggtggacggcatcatgaccatcgacctggaccccgtgatctacgactccaagttcgagaagcagctcgggcaggtcatgctgctggtgctctgcgccgtgcagctgctgctcatgcggaccagctgggcgctgtgcgaggccctgaccctcgccacgggccccatcaccaccctgtgggagggctccccggggaagttctggaacaccacgatcgccgtcagcatggccaacatcttccgcggctcctacctggcgggggccggcctcgccttcagcatcatgaagtccgtggggaccggccggcgcggcaccgggagccagggcgagaccctgggggagaagtggaagaagaagctgaaccagctctcccggaaggagttcgacctgtacaagaagtccggcatcaccgaggtggaccgcacggaggccaaggaggggctgaagcggggcgagaccacccaccacgcggtcagccgcggctccgccaagctccagtggttcgtggagcggaacatggtgatccccgaggggcgcgtcatcgacctgggctgcgggcgcggcgggtggagctactactgcgccggcctgaagaaggtgaccgaggtgcggggctacacgaagggcgggcccgggcacgaggagcccgtcccgatgtccacctacggctggaacatcgtgaagctcatgagcgggaaggacgtgttctacctgccgcccgagaagtgcgacaccctgctgtgcgacatcggcgagtccagcccctccccgaccgtcgaggagagccgcacgatccgggtgctcaagatggtggagccctggctgaagaacaaccagttctgcatcaaggtcctgaacccctacatgcccaccgtgatcgagcacctcgagcgcctgcagcggaagtacggcgggatgctggtgcgcaacccgctctcccggaacagcacccacgagatgtactggatctccaacggcaccgggaacatcgtcagctccgtgaacatggtcagccgcctgctgctcaaccggttcacgatgacccaccgccggcccaccatcgagaaggacgtggacctgggcgccggcacccgccacgtgaacgccgagcccgagacgccgaacatggacgtcatcggggagcggatcaagcgcatcaaggaggagcactccagcacctggcactacgacgacgagaacccctacaagacctgggcgtaccacggctcctacgaggtgaaggccaccgggagcgcctccagcatgatcaacggcgtggtcaagctgctcacgaagccctgggacgtggtgcccatggtcacccagatggccatgaccgacaccacgccgttcgggcagcagcgggtgttcaaggagaaggtggacacccgcacgccccggcccatgcccggcacccgcaaggtcatggagatcacggccgagtggctgtggcggaccctgggccgcaacaagaagccgcgcctctgcacccgggaggagttcaccaagaaggtgcgcacgaacgcggccatgggggccgtgttcaccgaggagaaccagtgggacagcgcccgggccgcggtcgaggacgaggagttctggaagctggtggaccgcgagcgggagctgcacaagctcggcaagtgcgggtcctgcgtgtacaacatgatgggcaagcgcgagaagaagctgggggagttcggcaaggccaagggcagccgggccatctggtacatgtggctgggggcccgcttcctcgagttcgaggcgctgggcttcctgaacgaggaccactggttctcccgggagaacagctactccggggtcgagggcgaggggctccacaagctgggctacatcctgcgcgacatcagcaagatccccggcggggccatgtacgccgacgacaccgccggctgggacacccggatcacggaggacgacctccacaacgaggagaagatcacccagcagatggaccccgagcaccgccagctggccaacgcgatcttcaagctgacctaccagaacaaggtggtgaaggtccagcggcccaccccgaaggggaccgtgatggacatcatctcccgcaaggaccagcggggcagcggccaggtggggacgtacggcctcaacaccttcaccaacatggaggcccagctggtccgccagatggagggggagggcgtgctgtccaagaccgacctcgagaacccccacctcctggagaagaagatcacgcagtggctcgagaacaagggggtggagcggctgaagcgcatggccatcagcggcgacgactgcgtcgtgaagcccatcgacgaccggttcgccaacgccctgctcgcgctgaacgacatgggcaaggtgcgcaaggacatcccccagtggcagccgtccaaggggtggcacgactggcagcaggtccccttctgcagccaccacttccacgagctgatcatgaaggacggccggaagctcgtggtgccctgccgcccccaggacgagctgatcgggcgcgcccggatctcccagggcgccgggtggagcctgaaggagaccgcctgcctcggcaaggcctacgcgcagatgtggtccctgatgtacttccaccgccgggacctgcgcctcgccagcaacgccatctgctccgccgtcccggtgcactgggtgcccaccagccggaccacgtggtccatccacgcccaccaccagtggatgaccaccgaggacatgctgaccgtctggaaccgcgtgtggatcgaggacaacccctggatggaggacaagacgcccgtgaccacctgggaggacgtcccgtacctgggcaagcgggaggaccagtggtgcgggagcctcatcggcctgaccagccgcgcgacgtgggcccagaacatcctgaccgccatccagcaggtccggtccctcatcggggacgaggagttcctggactacatgcccagcatgaagcgcttccggaaggaggaggagtccgagggcgccatctggtga

SEQ ID NO: 9964 - RNA, 9873 nt, synthetic construct
  misc_feature 1..9873: note = derived and/or modified CDS sequence (opt1) from DENV-3__FJ639722__SS-prME
  source 1..9873: mol_type = other RNA
accagcctgtgcctcatgatgatgctgcccgcgaccctggccttccacctcaccagccgggacggcgagccccggatgatcgtggggaagaacgagcgcggcaagagcctgctgttcaagaccgcgaccgggatcaacatgtgcaccctcatcgccatggacctgggcgagatgtgcgacgacacggtgacctacaagtgccccctgatcgccgaggtggagcccgaggacatcgactgctggtgcaacctcacctccacctgggtgacgtacgggacctgcaaccaggccggcgagcaccggcgcgacaagcggagcgtcgccctggcgccccacgtgggcatggggctggacacccgcacccagacgtggatgtccgccgagggcgcctggcgccaggtggagaaggtcgagacctgggccctccgccacccggggttcaccatcctggcgctgttcctcgcccactacatcggcaccagcctgatccagaaggtggtgatcttcatcctgctcatgctggtcacgccctccatgaccatgcggtgcgtgggggtgggcaaccgcgacttcgtcgagggcctgagcggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgactcccgctgccccacgcagggcgaggccatcctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggcctccaccgtggaggccgtgctgcccgagtacggcaccctcgggctggagtgcagcccgcgcaccggcctggacttcaacgagatgatcctcctgaccatgaagaacaaggcgtggatggtccaccggcagtggttcttcgacctgcccctcccctggacgtccggcgccaccaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacccagcacgggacgatcctgatcaaggtggagtacaagggcgaggacgccccgtgcaagatccccttctccaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggagaaggccctcaagatcaactggtacaagaagggcagctccatcgggaagatgttcgaggcgacggcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacctggacggagcagtacaagttccaggccgacagccccaagcgcctggcgaccgccatcgccggcgcctgggagaacggggtgtgcggcatccgctccaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtacagctggaagacctgggggaaggcgaagatcgtgacggccgagacccagaactccagcttcatcatcgacggccccaacacccccgagtgcccctccgccagccgggcctggaacgtgtgggaggtcgaggactacgggttcggcgtgttcaccacgaacatctggctgaagctccgcgaggtgtacacccagtcctgcgaccaccggctgatgagcgcggccatcaaggacgagcgcgccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcaccttcgtcctcctgctgagcggccagatcacgtggcgcgacatggcgcacaccctcatcatgatcggctccaacgccagcgaccggatggggatgggcgtgacctacctggccctgatcgccaccttcaagatccagcccttcctcgccctggggttcttcctgcgcaagctcacgtcccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgcagcaacacgatcttcaccctgaccgtggcctggcgcaccgccacgctcatcctggccggggtctccctgctcccgctgtgccagagctccagcatgcggaagaccgactggctgcccatgaccgtggccgcgatgggcgtgccgcccctgccgctgttcatcttctccctgaaggacgcccccaagcgccgcagctggcccctcaacgagggggtcatggccgtgggcctggtgtccatcctggccagctccctcctgcggaacgacgtccccatggccggcccgctggtggccggcgggctcctgatcgcctgctacgtgatcaccgggacgagcgccgacctgaccgtcgagaaggccgccgacgtgacctgggaggaggaggcggagcagaccggggtgtcccacaacctcatgatcacggtcgacgacgacgggaccatgcgcatcaaggacgacgagaccgagaacatcctgaccgtgctgctcaagaccgccctgctgatcgtgagcggcatcttcccctactccatccccgccacgctcctggtctggcacacctggcagaagcagacccagcggagcggcgtgctgtgggacgtgccctccccgcccgagacccagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacccacaacgggaagcgcctggagcccaactgggcgagcgtgaagaaggacctcatctcctacggcgggggctggcggctgagcacgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggacctccggcagcccgatcatcaaccgcgagggcaaggtggtcgggctgtacggcaacggggtggtgaccaagaacggcgggtacgtcagcggcatcgcgcagaccaacgccgagcccgacggccccacgcccgagctcgaggaggagatgttcaagaagcggaacctgaccatcatggacctgcacccggggtccggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagagcgagcacacgggccgggagatcgtggacctcatgtgccacgccaccttcaccatgcgcctgctgtccccggtgcgggtccccaactacaacctcatcatcatggacgaggcgcacttcaccgaccccgccagcatcgccgcccgcgggtacatctccacgcgggtgggcatgggcgaggccgcggccatcttcatgaccgccacgccgcccgggaccgccgaggcgttcccccagagcaacgcccccatccaggacgaggagcgcgacatccccgagcgctcctggaacagcggcaacgagtggatcacggacttcgtggggaagaccgtctggttcgtgccctccatcaaggccggcaacgacatcgccaactgcctgcggaagaacgggaagaaggtgatccagctgagccgcaagaccttcgacaccgagtaccagaagacgcggctcaacgactgggacttcgtcgtgaccaccgacatctccgagatgggcgccaacttcaaggcggaccgcgtgatcgacccccggcgctgcctgaagcccgtcatcctgaccgacggccccgagcgggtgatcctcgccgggccgatgcccgtgacggccgccagcgccgcgcagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagagccgcaagaccttcgtggagctcatgcggcgcggggacctgcccgtctggctggcccacaaggtggcctccgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcccggacctacagcgaccccctcgcgctgaaggagttcaaggacttcgccgccggccgcaagtccatcgccctggacctcgtcaccgagatcgggcgggtgcccagccacctggcccaccgcacgcggaacgcgctggacaacctcgtgatgctgcacacctccgagcacggcgggcgcgcctaccggcacgccgtcgaggagctgccggagaccatggagaccctcctgctgctcggcctgatgatcctgctcaccggcggggccatgctgttcctggtgagcgggaaggggatcggcaagaccaccatcgggctcatctgcgtgatcgtcagctccggcatgctgtggatggccgacatccccctgcagtggatcgcgagcgccatcgtgctcgagttcttcatgatggtgctgctgatccccgagcccgagaagcagcgcaccccgcaggacaaccagctcgcctacgtcgtgatcgggatcctgacgctggccgccatcgtggcggccaacgagatgggcctcctggagaccaccaagcgggacctgggcatgtccaaggagcccggggtcgtgagccccacctcctacctcgacgtggacctgcaccccgccagcgcctggacgctgtacgccgtcgcgaccaccgtgatcaccccgatgctccgccacacgatcgagaactccaccgccaacgtgagcctggccgccatcgcgaaccaggccgtcgtgctgatgggcctcgacaaggggtggcccatctccaagatggacctgggcgtgcccctgctcgccctggggtgctacagccaggtcaaccccctgaccctcaccgccgccgtgctgctgctcgtgacgcactacgcgatcatcggcccgggcctgcaggccaaggccacccgggaggcccagaagcgcaccgccgcggggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggccctgaccctcgccaccggccccatcacgaccctgtgggagggctccccggggaagttctggaacaccaccatcgcggtgagcatggccaacatcttccgcggctcctacctggccggggccggcctcgcgttcagcatcatgaagtccgtcgggacgggccggcgcggcaccgggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagacgacccaccacgccgtgagccgcggctccgccaagctccagtggttcgtcgagcggaacatggtgatccccgaggggcgcgtgatcgacctgggctgcgggcgcggcgggtggagctactactgcgccggcctgaagaaggtcaccgaggtgcggggctacaccaagggcggccccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccgcaccatccgggtcctcaagatggtggagccctggctgaagaacaaccagttctgcatcaaggtgctgaacccctacatgcccacggtcatcgagcacctcgagcgcctgcagcggaagtacggcgggatgctggtgcgcaacccgctctcccggaacagcacccacgagatgtactggatctccaacggcaccgggaacatcgtgagctccgtcaacatggtgagccgcctgctgctcaaccggttcaccatgacgcaccgccggcccaccatcgagaaggacgtcgacctgggcgcgggcacccgccacgtgaacgccgagcccgagaccccgaacatggacgtgatcggggagcggatcaagcgcatcaaggaggagcactccagcacgtggcactacgacgacgagaacccctacaagacctgggcctaccacggctcctacgaggtcaaggccaccgggagcgcctccagcatgatcaacggcgtggtgaagctgctcaccaagccctgggacgtcgtgcccatggtgacgcagatggcgatgaccgacaccaccccgttcgggcagcagcgggtcttcaaggagaaggtggacacgcgcacgccccggcccatgcccggcacccgcaaggtgatggagatcaccgccgagtggctgtggcggacgctgggccgcaacaagaagccgcgcctctgcacccgggaggagttcaccaagaaggtccgcaccaacgccgccatgggggccgtgttcacggaggagaaccagtgggacagcgcgcgggccgccgtggaggacgaggagttctggaagctggtcgaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttctcccgggagaacagctactccggggtggagggcgaggggctccacaagctgggctacatcctgcgcgacatcagcaagatccccggcggggccatgtacgccgacgacaccgcgggctgggacacccggatcaccgaggacgacctccacaacgaggagaagatcacgcagcagatggaccccgagcaccgccagctggccaacgccatcttcaagctgacctaccagaacaaggtcgtgaaggtgcagcggcccaccccgaaggggaccgtcatggacatcatctcccgcaaggaccagcggggcagcggccaggtggggacctacggcctcaacacgttcaccaacatggaggcccagctggtgcgccagatggagggggagggcgtcctgtccaagaccgacctcgagaacccccacctcctggagaagaagatcacccagtggctcgagaacaagggggtggagcggctgaagcgcatggccatcagcggcgacgactgcgtggtcaagcccatcgacgaccggttcgcgaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtcgtgccctgccgcccccaggacgagctgatcgggcgcgcccggatctcccagggcgccgggtggagcctgaaggagacggcgtgcctcggcaaggcctacgcccagatgtggtccctgatgtacttccaccgccgggacctgcgcctcgccagcaacgccatctgctccgcggtgccggtccactgggtgcccaccagccggaccacctggtccatccacgcccaccaccagtggatgacgaccgaggacatgctgaccgtgtggaaccgcgtctggatcgaggacaacccctggatggaggacaagacccccgtgacgacctgggaggacgtgccgtacctgggcaagcgggaggaccagtggtgcgggagcctcatcggcctgaccagccgcgccacctgggcccagaacatcctgacggcgatccagcaggtccggtccctcatcggggacgaggagttcctggactacatgcccagcatgaagcgcttccggaaggaggaggagtccgagggcgccatctggtga

SEQ ID NO: 9965 - RNA, 9873 nt, synthetic construct
  misc_feature 1..9873: note = derived and/or modified CDS sequence (opt1) from DENV-3__FJ639723__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgaccgggatcaacatgtgcaccctcatcgccatggacctgggcgagatgtgcgacgacaccgtgacctacaagtgccccctgatcgccgaggtggagcccgaggacatcgactgctggtgcaacctcacctccgcctgggtgacctacgggacctgcaaccaggccggcgagcaccggcgcgacaagcggagcgtggcgctggcgccccacgtgggcatggggctggacacccgcacccagacctggatgtccgccgagggcgcctggcgccaggtggagaaggtcgagacgtgggcgctccgccacccggggttcaccatcctggccctgttcctcgcccactacatcggcaccagcctgatccagaaggtggtgatcttcatcctgctcatgctggtcaccccctccatgacgatgcggtgcgtgggggtgggcaaccgcgacttcgtcgagggcctgagcggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgactcccgctgccccacccagggcgaggccatcctcccggaggagcaggaccagaactacgtgtgcaagcacacgtacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcaccgtgcacacgggggaccagcaccaggtcggcaacgacacccagggggtgaccgtcgagatcacgccccaggcctccacggtggaggcggtgctgcccgagtacggcaccctcgggctggagtgcagcccgcgcaccggcctggacttcaacgagatgatcctcctgaccatgaagaacaaggcctggatggtccaccggcagtggttcttcgacctgcccctcccctggacctccggcgccacgaccgagacccccacctggaaccgcaaggagctgctggtgacgttcaagaacgcccacgccaagaagcaggaggtggtcgtgctcgggagccaggagggcgcgatgcacaccgccctgaccggggccaccgagatccagaactccggcgggacgagcatcttcgccggccacctgaagtgccggctcaagatggacaagctggagctgaagggcatgtcctacgccatgtgcctcaacaccttcgtgctgcgcaaggaggtcagcgagacccagcacgggaccatcctgatcaaggtggagtacaagggcgaggacgcgccgtgcaagatccccttctccacggaggacgggcagggcaaggcccacaacggccggctgatcaccgccaaccccgtggtcaccaagaaggaggagcccgtgaacatcgaggccgagccgcccttcggggagagcaacatcgtgatcggcatcggggacaaggcgctcaagatcaactggtacaagaagggcagctccatcgggaagatgttcgaggccaccgcccgcggcgcccggcgcatggccatcctgggcgacacggcgtgggacttcgggagcgtcggcggggtgctgaactccctcggcaagatggtgcaccagatcttcgggagcgcctacaccgccctgttctccggcgtcagctggatcatgaagatcggcatcggggtgctgctcacctggatcggcctgaactccaagaacaccagcatgtccttcagctgcatcgtgatcgggatcatcacgctgtacctcggcgccgtcgtgcaggccgacatggggtgcgtgatcaactggaagggcaaggagctgaagtgcggctccgggatcttcgtcaccaacgaggtgcacacctggaccgagcagtacaagttccaggcggacagccccaagcgcctggccacggccatcgccggcgcctgggagaacggggtgtgcggcatccggtccaccacccgcatggagaacctcctgtggaagcagatcgcgaacgagctgaactacatcctctgggagaacaacatcaagctgaccgtcgtggtgggggacatcatcggcgtcctggagcagggcaagcggacgctcacgccccagccgatggagctgaagtacagctggaagacctgggggaaggccaagatcgtgaccgccgagacgcagaactccagcttcatcatcgacggccccaacacccccgagtgcccctccgccagccgcgcgtggaacgtgtgggaggtcgaggactacgggttcggcgtgttcaccaccaacatctggctgaagctccgggaggtgtacacgcagtcctgcgaccaccgcctgatgagcgccgccatcaaggacgagcgggccgtccacgccgacatgggctactggatcgagagccagaagaacgggtcctggaagctggagaaggcgagcttcatcgaggtgaagacctgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccaccaacgagaaggaggagaacatggtcaagtccctggtgagcgccggctccgggaaggtggacaacttcaccatgggcgtcctgtgcctcgccatcctgttcgaggaggtgatgcgcgggaagttcggcaagaagcacatgatcgcgggggtgctgttcaccttcgtcctcctgctgagcggccagatcacgtggcgggacatggcccacaccctcatcatgatcggctccaacgccagcgaccgcatggggatgggcgtgacctacctggccctgatcgccaccttcaagatccagcccttcctcgcgctggggttcttcctgcggaagctcacgtcccgcgagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgcagcaacacgatcttcaccctgaccgtggcctggcggaccgccacgctcatcctggccggggtctccctgctcccgctgtgccagagctccagcatgcgcaagaccgactggctgcccatgaccgtggcggccatgggcgtgccgcccctgccgctgttcatcttctccctgaaggacacccccaagcgccggagctggcccctcaacgagggggtcatggccgtgggcctggtgtccatcctggccagctccctcctgcgcaacgacgtccccatggccggcccgctggtggccggcgggctcctgatcgcctgctacgtgatcacggggaccagcgccgacctgaccgtcgagaaggccgccgacgtgacctgggaggaggaggcggagcagacgggggtgtcccacaacctcatgatcaccgtcgacgacgacgggaccatgcggatcaaggacgacgagaccgagaacatcctgaccgtgctgctcaagacggccctgctgatcgtgagcggcatcttcccctactccatccccgccaccctcctggtctggcacacctggcagaagcagacccagcgcagcggcgtgctgtgggacgtgccctccccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggcgagcgtgaagaaggacctcatctcctacggcgggggctggcgcctgagcacccagtggcagaagggggaggaggtgcaggtcatcgccgtggagcccggcaagaacccgaagaacttccagaccatgcccggcatcttccagaccacgaccggggagatcggcgccatcgccctggacttcaagcccgggacctccggcagcccgatcatcaaccgggagggcaaggtggtcgggctgtacggcaacggggtggtgaccaagaacggcgggtacgtcagcggcatcgcgcagacgaacgccgagcccgacggccccacccccgagctcgaggaggagatgttcaagaagcgcaacctgaccatcatggacctgcacccggggtccggcaagacccggaagtacctccccgccatcgtgcgcgaggccatcaagcggcgcctgcggacgctgatcctcgcccccacccgcgtggtcgcggccgagatggaggaggccctgaaggggctgcccatccggtaccagaccaccgccaccaagagcgagcacaccggccgcgagatcgtggacctcatgtgccacgccaccttcaccatgcggctgctgtccccggtgcgcgtccccaactacaacctcatcatcatggacgaggcgcacttcacggaccccgccagcatcgccgcccgggggtacatctccacccgcgtgggcatgggcgaggccgcggccatcttcatgaccgccacgccgcccgggacggccgaggcgttcccccagagcaacgcccccatccaggacgaggagcgcgacatccccgagcggtcctggaacagcggcaacgagtggatcaccgacttcgtggggaagaccgtctggttcgtgccctccatcaaggccggcaacgacatcgccaactgcctgcgcaagaacgggaagaaggtgatccagctgagccggaagaccttcgacacggagtaccagaagacccgcctcaacgactgggacttcgtcgtgaccaccgacatctccgagatgggcgccaacttcaaggcggaccgggtgatcgacccccgccggtgcctgaagcccgtcatcctgacggacggccccgagcgcgtgatcctcgccgggccgatgcccgtgaccgccgccagcgccgcgcagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagagccggaagacgttcgtggagctcatgcgccgcggggacctgcccgtctggctggcctacaaggtggcctccgagggcatcaagtacaccgaccgcaagtggtgcttcgacggggagcggaacaaccagatcctcgaggagaacatggacgtggagatctggaccaaggagggcgagcgcaagaagctgcgcccgcggtggctggacgcccgcacctacagcgaccccctcgcgctgaaggagttcaaggacttcgccgccggccggaagtccatcgccctggacctcgtcacggagatcgggcgcgtgcccagccacctggcccaccggacccgcaacgcgctggacaacctcgtgatgctgcacacctccgagcacggcgggcgggcctaccgccacgccgtcgaggagctgccggagaccatggagacgctcctgctgctcggcctgatgatcctgctcaccgggggcgccatgctgttcctgatcagcggcaaggggatcggcaagaccaccatcgggctcatctgcgtgatcgtgagctccggcatgctgtggatggccgacatccccctgcagtggatcgcgagcgccatcgtcctcgagttcttcatgatggtgctgctgatccccgagcccgagaagcagcggacgccgcaggacaaccagctcgcctacgtggtcatcgggatcctgaccctggccgccatcgtggcggccaacgagatgggcctcctggagaccaccaagcgcgacctgggcatgtccaaggagcccggggtggtcagccccacgtcctacctcgacgtggacctgcaccccgccagcgcctggaccctgtacgccgtggcgaccaccgtcatcacgccgatgctccggcacaccatcgagaactccaccgccaacgtgagcctggccgccatcgcgaaccaggccgtggtcctgatgggcctcgacaaggggtggcccatctccaagatggacctgggcgtgcccctgctcgccctggggtgctacagccaggtgaaccccctgaccctcacggccgccgtcctgctgctcgtgacccactacgcgatcatcggcccgggcctgcaggccaaggccacccgcgaggcccagaagcggaccgccgcggggatcatgaagaaccccacggtggacggcatcatgaccatcgacctggaccccgtcatctacgactccaagttcgagaagcagctcggccaggtgatgctgctggtgctctgcgccgtccagctgctgctcatgcgcaccagctgggccctgtgcgaggccctgaccctcgccacgggccccatcaccaccctgtgggagggctccccggggaagttctggaacaccacgatcgcggtgagcatggccaacatcttccggggctcctacctggccggggccggcctcgcgttcagcatcatgaagtccgtggggaccggccgccggggcaccgggagccagggcgagaccctgggggagaagtggaagaagaagctgaaccagctctcccgcaaggagttcgacctgtacaagaagtccggcatcaccgaggtcgaccggacggaggccaaggaggggctgaagcgcggcgagaccacccaccacgccgtgagccggggctccgccaagctccagtggttcgtggagcgcaacatggtcatccccgaggggcgcgtgatcgacctgggctgcgggcggggcgggtggagctactactgcgccggcctgaagaaggtgaccgaggtccgcggctacacgaagggcgggcccgggcacgaggagcccgtgccgatgtccacctacggctggaacatcgtgaagctcatgagcgggaaggacgtcttctacctgccgcccgagaagtgcgacaccctgctgtgcgacatcggcgagtccagcccctccccgaccgtggaggagagccggacgatccgcgtgctcaagatggtcgagccctggctgaagaacaaccagttctgcatcaaggtgctgaacccctacatgcccaccgtgatcgagcacctcgagcggctgcagcgcaagtacggcgggatgctggtccggaacccgctctcccgcaacagcacccacgagatgtactggatctccaacggcaccgggaacatcgtgagctccgtgaacatggtcagccggctgctgctcaaccgcttcacgatgacccaccggcgccccaccatcgagaaggacgtggacctgggcgcgggcacccggcacgtcaacgccgagcccgagacgccgaacatggacgtgatcggggagcgcatcaagcggatcaaggaggagcactccagcacctggcactacgacgacgagaacccctacaagacctgggcctaccacggctcctacgaggtgaaggccaccgggagcgcctccagcatgatcaacggcgtcgtgaagctgctcacgaagccctgggacgtggtccccatggtgacccagatggcgatgaccgacaccacgccgttcgggcagcagcgcgtgttcaaggagaaggtcgacacccggacgccccggcccatgcccggcacccggaaggtgatggagatcacggccgagtggctgtggcgcaccctgggccgcaacaagaagccgcggctctgcacccgcgaggagttcaccaagaaggtgcggacgaacgccgccatgggggccgtcttcaccgaggagaaccagtgggacagcgcgcgcgccgccgtggaggacgaggagttctggaagctggtggaccgggagcgcgagctgcacaagctcggcaagtgcgggtcctgcgtctacaacatgatgggcaagcgggagaagaagctgggggagttcggcaaggccaagggcagccgcgcgatctggtacatgtggctgggggcccggttcctcgagttcgaggccctgggcttcctgaacgaggaccactggttctcccgcgagaacagctactccggggtggagggcgaggggctccacaagctgggctacatcctgcgggacatcagcaagatccccggcggggccatgtacgccgacgacaccgcgggctgggacacccgcatcacggaggacgacctccacaacgaggagaagatcacccagcagatggaccccgagcaccggcagctggccaacgccatcttcaagctgacctaccagaacaaggtggtcaaggtgcagcgccccaccccgaaggggaccgtgatggacatcatctcccggaaggaccagcgcggcagcggccaggtcgggacgtacggcctcaacaccttcaccaacatggaggcccagctggtgcggcagatggagggggagggcgtgctgtccaaggccgacctcgagaacccccacctcctggagaagaagatcacccagtggctcgagaacaagggggtcgagcgcctgaagcggatggcgatcagcggcgacgactgcgtggtgaagcccatcgacgaccgcttcgccaacgccctgctcgccctgaacgacatgggcaaggtccggaaggacatcccccagtggcagccgtccaaggggtggcacgactggcagcaggtccccttctgcagccaccacttccacgagctgatcatgaaggacggccgcaagctcgtggtcccctgccgcccccaggacgagctgatcgggcgggcccgcatctcccagggcgcggggtggagcctgaaggagacggcctgcctcggcaaggcctacgcccagatgtggtccctgatgtacttccaccggcgcgacctgcggctcgccagcaacgcgatctgctccgccgtgccggtgcactgggtccccaccagccgcaccacctggtccatccacgcccaccaccagtggatgacgaccgaggacatgctggccgtgtggaaccgggtgtggatcgaggacaacccctggatggaggacaagacccccgtcaccacgtgggaggacgtgccgtacctgggcaagcgcgaggaccagtggtgcgggagcctcatcggcctgaccagccgggcgacctgggcccagaacatcctgaccgccatccagcaggtccgctccctcatcggggacgaggagttcctggactacatgcccagcatgaagcggttccgcaaggaggaggagtccgagggcgccatctggtga

SEQ ID NO: 9966 - RNA, 9873 nt, synthetic construct
  misc_feature 1..9873: note = derived and/or modified CDS sequence (opt1) from DENV-3__FJ639724__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtggagcgcgtcgagacgtgggccctccggcacccggggttcaccatcctggcgctgttcctcgcccactacatcggcacctccctgacccagaaggtggtgatcttcatcctgctcatgctggtcacgcccagcatgaccatgcgctgcgtgggggtgggcaaccgggacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcgcaagctgtgcatcgagggcaagatcaccaacatcaccaccgactcccggtgccccacgcagggcgaggccaccctcccggaggagcaggaccagaactacgtgtgcaagcacacctacgtcgaccgcgggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcaccccccaggcctccaccgtggaggccgtgctgcccgagtacggcaccctcgggctggagtgcagcccgcggaccggcctggacttcaacgagatgatcctcctgacgatgaagaacaaggcgtggatggtccaccgccagtggttcttcgacctgcccctcccctggacctccggcgccaccaccgagacgcccacctggaaccggaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccgcctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccggctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccgcggcgcccggcgcatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccggtccaccacgcgcatggagaacctcctgtggaagcagatcgccaacgagctgaactacatcctctgggagaacaacatcaagctgaccgtcgtggtgggggacatcatcggcgtcctggagcagggcaagcggaccctcaccccccagccgatggagctgaagtacagctggaagacgtgggggaaggcgaagatcgtgaccgccgagacccagaactccagcttcatcatcgacggccccaacacccccgagtgcccctccgccagccgcgcctggaacgtgtgggaggtcgaggactacgggttcggcgtgttcacgaccaacatctggctgaagctccgggaggtgtacacccagagctgcgaccaccgcctgatgtccgcggccatcaaggacgagcgggccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccgcccgggctaccacacccagaccaccgggccctggcacctcggcaagctggagctggacttcaactactgcgagggcacgaccgtcgtgatcaccgagaactgcgggacccggggccccagcctccgcacgaccaccgtgtccgggaagctgatccacgagtggtgctgccggagctgcaccctgcccccgctccgctacatgggcgaggacgggtgctggtacggcatggagatccggcccatcaacgagaaggaggagaacatggtcaagtccctggtgagcgccggctccgggaaggtggacaacttcacgatgggcgtcctgtgcctcgccatcctgttcgaggaggtgatgcgcgggaagttcggcaagaagcacatgatcgccggggtgctgttcaccttcgtcctcctgctgagcggccagatcacctggcgggacatggcccacaccctcatcatgatcggctccaacgcgagcgaccgcatggggatgggcgtgacgtacctggccctgatcgccaccttcaagatccagcccttcctcgccctggggttcttcctgcggaagctcaccagccgcgagaacctgctgctcggcgtgggcctggccatggcgaccacgctgcagctccccgaggacatcgagcagatggccaacgggatcgccctgggcctgatgaccctcaagctgatcacccagttcgagacctaccagctgtggacggccctcgtctccctgacctgcagcaacaccatcttcaccctgacggtggcgtggcggaccgccaccctcatcctggccggggtctccctgctcccgctgtgccagagctccagcatgcgcaagaccgactggctgcccatgacggtggccgccatgggcgtgccccccctcccgctgttcatcttctccctgaaggacacccccaagcgccggagctggcccctcaacgagggggtcatggcggtgggcctggtgtccatcctggccagctccctcctgcgcaacgacgtccccatggccggcccgctggtggccgggggcctcctgatcgcctgctacgtgatcaccgggaccagcgcggacctgacggtcgagaaggccgccgacgtgacctgggaggaggaggccgagcagaccggcgtgtcccacaacctcatgatcaccgtcgacgacgacgggaccatgcggatcaaggacgacgagacggagaacatcctgaccgtgctgctcaagaccgccctgctgatcgtgagcggcatcttcccctactccatccccgcgaccctcctggtctggcacacgtggcagaagcagacccagcgcagcggcgtgctgtgggacgtgccctccccgcccgagacccagaaggccgagctcgaggagggggtctaccggatcaagcagcagggcatcttcgggaagacccaggtgggcgtgggggtccagaaggagggcgtgttccacacgatgtggcacgtgacccgcggcgccgtcctgacccacaacgggaagcggctggagcccaactgggccagcgtgaagaaggacctcatctcctacggcgggggctggcgcctgagcgcccagtggcagaagggggaggaggtgcaggtcatcgcggtggagcccggcaagaacccgaagaacttccagaccatgcccggcatcttccagacgaccaccggggagatcggcgccatcgccctggacttcaagcccgggaccagcggctccccgatcatcaaccgggagggcaaggtggtcgggctgtacggcaacggggtggtgacgaagaacggcgggtacgtcagcggcatcgcccagaccaacgcggagcccgacggccccacccccgagctcgaggaggagatgttcaagaagcgcaacctgaccatcatggacctgcacccggggtccggcaagacgcggaagtacctccccgccatcgtgcgcgaggccatcaagcggcgcctgcggaccctgatcctcgcccccacccgcgtggtcgccgcggagatggaggaggccctgaaggggctgcccatccggtaccagaccacggccaccaagagcgagcacaccggccgcgagatcgtggacctcatgtgccacgccaccttcacgatgcggctgctgtccccggtgcgcgtccccaactacaacctcgtgatcatggacgaggcccacttcaccgaccccgcgagcatcgccgcccgggggtacatctccacccgcgtgggcatgggcgaggccgccgcgatcttcatgaccgccacgcccccggggaccgccgaggccttcccccagagcaacgcgcccatccaggacgaggagcgcgacatccccgagcggtcctggaacagcggcaacgagtggatcaccgacttcgtcgggaagaccgtgtggttcgtgccgtccatcaaggccggcaacgacatcgccaactgcctgcgcaagaacgggaagaaggtcatccagctgagccggaagacgttcgacaccgagtaccagaagacccgcctcaacgactgggacttcgtggtgaccacggacatctccgagatgggcgccaacttcaaggccgaccgggtcatcgacccccgccggtgcctgaagcccgtgatcctgaccgacggccccgagcgcgtgatcctcgcggggccgatgcccgtcaccgccgccagcgccgcccagcggcgcggccgggtggggcgcaacccccagaaggagaacgaccagtacatcttcaccggccagcccctgaacaacgacgaggaccacgcgcactggaccgaggccaagatgctgctcgacaacatcaacacgccggaggggatcatccccgccctgttcgagcccgagcgggagaagtccgccgccatcgacggcgagtaccgcctgaagggcgagagccggaagaccttcgtcgagctcatgcgccggggggacctgcccgtgtggctggcgcacaaggtggcctccgagggcatcaagtacaccgaccgcaagtggtgcttcgacggggagcggaacaaccagatcctcgaggagaacatggacgtcgagatctggaccaaggagggcgagcgcaagaagctgcgcccgcggtggctggacgcccgcacgtacagcgaccccctcgccctgaaggagttcaaggacttcgcggccggccggaagtccatcgccctggacctcgtgaccgagatcgggcgcgtgcccagccacctggcccaccggacccgcaacgccctggacaacctcgtcatgctgcacaccagcgagcacggcgggcgggcgtaccgccacgccgtggaggagctgccggagacgatggagaccctcctgctgctcggcctgatgatcctgctcaccgggggcgccatgctgttcctgatctccggcaaggggatcggcaagaccagcatcgggctcatctgcgtgatcgtctccagcggcatgctgtggatggccgacgtgcccctgcagtggatcgcctccgcgatcgtgctcgagttcttcatgatggtcctgctgatccccgagcccgagaagcagcggacgccgcaggacaaccagctcgcctacgtggtgatcgggatcctgaccctggccgccatcgtcgccgcgaacgagatgggcctcctggagaccaccaagcgcgacctgggcatgagcaaggagcccggggtggtgtcccccacgagctacctcgacgtcgacctgcaccccgcctccgcctggaccctgtacgccgtggccaccaccgtgatcacgccgatgctccggcacaccatcgagaacagcaccgcgaacgtctccctggccgccatcgccaaccaggcggtggtgctgatgggcctcgacaaggggtggcccatcagcaagatggacctgggcgtccccctgctcgccctggggtgctactcccaggtgaaccccctgaccctcacggccgccgtgctgctgctcgtcacccactacgccatcatcggcccgggcctgcaggcgaaggccacccgcgaggcccagaagcggaccgccgccgggatcatgaagaaccccacggtggacggcatcatgaccatcgacctggaccccgtgatctacgacagcaagttcgagaagcagctcgggcaggtcatgctgctggtgctctgcgcggtgcagctgctgctcatgcgcacctcctgggccctgtgcgaggccctgaccctcgccacgggccccatcaccaccctgtgggagggcagcccggggaagttctggaacaccacgatcgccgtctccatggcgaacatcttccggggcagctacctggccggggccggcctcgccttctccatcatgaagagcgtggggaccggccgccggggcaccgggagccagggcgagaccctgggggagaagtggaagaagaagctgaaccagctctcccgcaaggagttcgacctgtacaagaagagcggcatcaccgaggtggaccggacggaggcgaaggaggggctgaagcgcggcgagaccacccaccacgccgtctcccggggcagcgccaagctccagtggttcgtggagcgcaacatggtgatccccgaggggcgcgtcatcgacctgggctgcgggcggggcgggtggtcctactactgcgccggcctgaagaaggtgaccgaggtgcgcggctacacgaaggggggccccgggcacgaggagcccgtcccgatgagcacctacggctggaacatcgtgaagctcatgtccgggaaggacgtgttctacctgccccccgagaagtgcgacaccctgctgtgcgacatcggcgagagctcccccagcccgaccgtcgaggagtcccggacgatccgcgtgctcaagatggtggagccctggctgcggaacaaccagttctgcatcaaggtcctgaacccctacatgcccaccgtgatcgagcacctcgagcgcctgcagcggaagtacggcgggatgctggtgcgcaacccgctcagccggaactccacccacgagatgtactggatcagcaacggcaccgggaacatcgtctccagcgtgaacatggtctcccgcctgctgctcaaccggttcacgatgacccaccgccggcccaccatcgagaaggacgtggacctgggcgccggcacccgccacgtgaacgcggagcccgagacgccgaacatggacgtcatcggggagcggatcaagcgcatcaaggaggagcacagctccacctggcactacgacgacgagaacccctacaagacctgggcctaccacggcagctacgaggtgaaggccaccgggagcgcctccagcatgatcaacggcgtggtcaagctgctcacgaagccctgggacgtggtgcccatggtcacccagatggccatgaccgacaccacgccgttcgggcagcagcgggtgttcaaggagaaggtggacacccgcaccccccggcccatgcccggcacccgcaaggtcatggagatcacggcggagtggctgtggcgcaccctgggccggaacaagaagccgcgcctctgcacccgggaggagttcaccaagaaggtgcgcacgaacgccgccatgggggccgtgttcaccgaggagaaccagtgggactccgcccgggcggccgtcgaggacgaggagttctggaagctggtggaccgcgagcgggagctgcacaagctcggcaagtgcgggagctgcgtgtacaacatgatgggcaagcgcgagaagaagctgggggagttcggcaaggccaagggctcccgggccatctggtacatgtggctgggggcgcgctacctcgagttcgaggccctgggcttcctgaacgaggaccactggttcagccgggagaactcctacagcggggtcgagggcgaggggctccacaagctgggctacatcctgcgcgacatctccaagatccccggcggggccatgtacgccgacgacaccgccggctgggacacccggatcacggaggacgacctccacaacgaggagaagatcacccagcagatggaccccgagcaccgccagctggcgaacgccatcttcaagctgacctaccagaacaaggtggtgaaggtccagcggcccaccccgaaggggaccgtgatggacatcatcagccgcaaggaccagcggggctccggccaggtggggacgtacggcctcaacaccttcaccaacatggaggcccagctggtccgccagatggagggggagggcgtgctgagcaaggccgacctcgagaacccccacctgctggagaagaagatcacccagtggctcgagacgaagggggtggagcggctgaagcgcatggccatctccggcgacgactgcgtcgtgaagcccatcgacgaccggttcgcgaacgccctgctcgccctgaacgacatgggcaaggtgcgcaaggacatcccccagtggcagccgagcaaggggtggcacgactggcagcaggtccccttctgctcccaccacttccacgagctgatcatgaaggacggccgcaagctcgtggtgccctgccggccccaggacgagctgatcgggcgcgcccggatcagccagggcgccgggtggtccctgaaggagaccgcgtgcctcggcaaggcctacgcccagatgtggagcctgatgtacttccaccgccgggacctgcgcctcgcctccaacgccatctgcagcgcggtcccggtgcactggatccccaccagccggaccacgtggtccatccacgcccaccaccagtggatgaccaccgaggacatgctgaccgtgtggaaccgcgtctggatcgaggacaacccctggatggaggacaagacgcccgtgaccacctgggaggacgtgccgtacctgggcaagcgggaggaccagtggtgcgggagcctcatcggcctgacctcccgcgccacgtgggcccagaacatcctgaccgcgatccagcaggtccggagcctcatcggggacgaggagttcctggactacatgccctccatgaagcgcttccggaaggaggaggagagcgagggcgccatctggtga

SEQ ID NO: 9967 - RNA, 9873 nt, synthetic construct
  misc_feature 1..9873: note = derived and/or modified CDS sequence (opt1) from DENV-3__FJ639725__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggcgaagatcgtgaccgccgagacccagaactccagcttcatcatcgacggccccaacacccccgagtgcccctccgccagccgggcctggaacgtgtgggaggtcgaggactacgggttcggcgtgttcacgaccaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcacgttcgtcctcctgctgagcggccagatcacctggcgcgacatggcgcacaccctcatcatgatcggctccaacgccagcgaccggatggggatgggcgtgacctacctggccctgatcgccacgttcaagatccagcccttcctcgccctggggttcttcctgcgcaagctcaccagccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtctccctgacgtgcagcaacaccatcttcaccctgaccgtggcctggcgcacggccaccctcatcctggccggggtctccctgctcccgctgtgccagagctccagcatgcggaagaccgactggctgcccatgaccgtggccgcgatgggcgtgccgcccctgccgctgttcatcttctccctgaaggacacgcccaagcgccgcagctggcccctcaacgagggggtcatggccgtgggcctggtgtccatcctggccagctccctcctgcggaacgacgtccccatggccggcccgctggtggccgggggcctcctgatcgcgtgctacgtgatcaccgggaccagcgccgacctgaccgtcgagaaggccgccgacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgcgctgctgatcgtgagcggcatcttcccctactccatccccgccaccctcctggtctggcacacctggcagaagcagacgcagcggagcggcgtgctgtgggacgtgccctccccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctggagcccaactgggccagcgtgaagaaggacctcatctcctacggcgggggctggcggctgagcgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggctccccgatcatcaaccgcgagggcaaggtggtcgggctgtacggcaacggggtggtgaccaagaacggcgggtacgtcagcggcatcgcgcagacgaacgccgagcccgacggccccacccccgagctcgaggaggagatgttcaagaagcggaacctgaccatcatggacctgcacccggggtccggcaagacccgcaagtacctccccgccatcgtgcgggaggccatcaagcgccggctgcgcacgctgatcctcgcccccacccgggtggtcgcggccgagatggaggaggccctgaaggggctgcccatccgctaccagaccaccgccaccaagagcgagcacaccggccgggagatcgtggacctcatgtgccacgccaccttcaccatgcgcctgctgtccccggtgcgggtccccaactacaacctcgtgatcatggacgaggcgcacttcacggaccccgccagcatcgccgcccgcgggtacatctccacccgggtgggcatgggcgaggccgcggccatcttcatgaccgccacgccgcccgggacggccgaggcgttcccccagagcaacgcccccatccaggacgaggagcgcgacatccccgagcgctcctggaacagcggcaacgagtggatcaccgacttcgtcgggaagaccgtgtggttcgtgccctccatcaaggccggcaacgacatcgccaactgcctgcggaagaacgggaagaaggtcatccagctgagccgcaagaccttcgacacggagtaccagaagacccggctcaacgactgggacttcgtggtgaccaccgacatctccgagatgggcgccaacttcaaggcggaccgcgtcatcgacccccggcgctgcctgaagcccgtgatcctgacggacggccccgagcgggtgatcctcgccgggccgatgcccgtcaccgccgccagcgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagagccgcaagacgttcgtcgagctcatgcggcgcggggacctgcccgtgtggctggcccacaaggtggcctccgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcccggacctacagcgaccccctcgcgctgaaggagttcaaggacttcgccgccggccgcaagtccatcgccctggacctcgtgacggagatcgggcgggtgcccagccacctggcccaccgcacccggaacgcgctggacaacctcgtcatgctgcacaccagcgagcacggcgggcgcgcctaccggcacgccgtggaggagctgccggagaccatggagacgctcctgctgctcggcctgatgatcctgctcaccgggggcgccatgctgttcctgatctccggcaaggggatcggcaagaccagcatcgggctcatctgcgtgatcgcctccagcggcatgctgtggatggcggacgtccccctgcagtggatcgcctccgccatcgtgctcgagttcttcatgatggtgctgctgatccccgagcccgagaagcagcgcaccccgcaggacaaccagctcgcctacgtcgtgatcgggatcctgacgctggccgcgatcgtggccgccaacgagatgggcctcctggagaccaccaagcgggacctgggcatgagcaaggagcccggggtcgtgtcccccaccagctacctcgacgtggacctgcaccccgcctccgcctggacgctgtacgcggtcgccaccaccgtgatcaccccgatgctccgccacacgatcgagaacagcaccgccaacgtgtccctggccgcgatcgccaaccaggccgtcgtgctgatgggcctcgacaaggggtggcccatcagcaagatggacctgggcgtgcccctgctcgccctggggtgctactcccaggtcaaccccctgaccctcaccgccgcggtgctgctgctcgtgacgcactacgccatcatcggcccgggcctgcaggccaaggccacccgggaggcccagaagcgcaccgcggccgggatcatgaagaaccccaccgtcgacggcatcatgacgatcgacctggaccccgtgatctacgacagcaagttcgagaagcagctcggccaggtgatgctgctggtcctctgcgccgtgcagctgctgctcatgcggacctcctgggccctgtgcgaggccctgaccctcgcgaccggccccatcacgaccctgtgggagggcagcccggggaagttctggaacaccaccatcgccgtgtccatggccaacatcttccgcggcagctacctggccggggcgggcctcgccttctccatcatgaagtccgtcgggacgggccggcgcggcaccgggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagacgacccaccacgccgtgtcccgcggcagcgccaagctccagtggttcgtcgagcggaacatggtgatccccgaggggcgcgtgatcgacctgggctgcgggcgcggcgggtggtcctactactgcgcgggcctgaagaaggtcaccgaggtgcggggctacaccaagggcgggcccgggcacgaggagcccgtgccgatgagcacgtacggctggaacatcgtcaagctcatgtccgggaaggacgtgttctacctgccgcccgagaagtgcgacaccctgctgtgcgacatcggcgagagctcccccagcccgaccgtggaggagtcccgcaccatccgggtcctcaagatggtggagccctggctgcgcaacaaccagttctgcatcaaggtgctgaacccctacatgcccacggtcatcgagcacctcgagcggctgcagcgcaagtacggcgggatgctggtgcggaacccgctcagccgcaactccacccacgagatgtactggatcagcaacggcaccgggaacatcgtgtccagcgtcaacatggtgtcccggctgctgctcaaccgcttcaccatgacgcaccggcgccccaccatcgagaaggacgtcgacctgggcgccggcacccggcacgtgaacgccgagcccgagaccccgaacatggacgtgatcggggagcgcatcaagcggatcaaggaggagcacagctccacgtggcactacgacgacgagaacccctacaagacctgggcctaccacggcagctacgaggtcaaggccaccgggagcgcgtccagcatgatcaacggcgtggtgaagctgctcaccaagccctgggacgtcgtgcccatggtgacgcagatggccatgaccgacaccaccccgttcgggcagcagcgcgtcttcaaggagaaggtggacacgcggacgccccggcccatgcccggcacccggaaggtgatggagatcaccgccgagtggctgtggcgcacgctgggccgcaacaagaagccgcggctctgcacccgcgaggagttcaccaagaaggtccggaccaacgccgccatgggggcggtgttcacggaggagaaccagtgggactccgcccgcgccgccgtggaggacgaggagttctggaagctggtcgaccgggagcgcgagctgcacaagctcggcaagtgcgggagctgcgtgtacaacatgatgggcaagcgggagaagaagctgggggagttcggcaaggcgaagggctcccgcgccatctggtacatgtggctgggggcccggtacctcgagttcgaggccctgggcttcctgaacgaggaccactggttcagccgcgagaactcctacagcggggtggagggcgaggggctccacaagctgggctacatcctgcgggacatctccaagatccccggcggggccatgtacgcggacgacaccgccggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccaccccgaaggggaccgtcatggacatcatcagccggaaggaccagcgcggctccggccaggtggggacctacggcctcaacacgttcaccaacatggaggcccagctggtgcggcagatggagggggagggcgtcctgagcaaggcggacctcgagaacccccacctcctggggaagaagatcacccagtggctcgagaccaagggcgtggagcgcctgaagcggatggccatctccggcgacgactgcgtggtcaagcccatcgacgaccgcttcgccaacgccctgctcgccctgaacgacatggggaaggtgcggaaggacatcccccagtggcagccgagcaagggctggcacgactggcagcaggtccccttctgctcccaccacttccacgagctgatcatgaaggacgggcgcaagctcgtcgtgccctgccgcccccaggacgagctgatcggccgggcgcgcatcagccagggggccggctggtccctgaaggagacggcctgcctcggcaaggcctacgcccagatgtggagcctgatgtacttccaccggcgcgacctgcggctcgcgtccaacgccatctgcagcgccgtgccggtccactggatccccaccagccgcaccacctggtccatccacgcccaccaccagtggatgacgaccgaggacatgctgaccgtgtggaaccgggtgtggatcgaggacaacccctggatggaggacaagacccccgtcacgacctgggaggacgtgccgtacctggggaagcgcgaggaccagtggtgcggcagcctcatcgggctgacctcccgggcgacctgggcccagaacatcctgacggccatccagcaggtccgcagcctcatcggcgacgaggagttcctggactacatgccctccatgaagcggttccgcaaggaggaggagagcgagggggccatctggtga

SEQ ID NO: 9968 - RNA, 9873 nt, synthetic construct
  misc_feature 1..9873: note = derived and/or modified CDS sequence (opt1) from DENV-3__FJ639726__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtggagcgcgtcgagacgtgggccctccggcacccggggttcaccatcctggcgctgttcctcgcccactacatcggcacctccctgacccagaaggtggtgatcttcatcctgctcatgctggtcacgcccagcatgaccatgcgctgcgtgggggtgggcaaccgggacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcgcaagctgtgcatcgagggcaagatcaccaacatcaccaccgactcccggtgccccacgcagggcgaggccaccctcccggaggagcaggaccagaactacgtgtgcaagcacacctacgtcgaccgcgggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcaccccccaggcctccaccgtggaggccgtgctgcccgagtacggcaccctcgggctggagtgcagcccgcggaccggcctggacttcaacgagatgatcctcctgacgatgaagaacaaggcgtggatggtccaccgccagtggttcttcgacctgcccctcccctggacctccggcgccaccaccgagacgcccacctggaaccggaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccgcctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccggctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccgcggcgcccggcgcatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccggtccaccacgcgcatggagaacctcctgtggaagcagatcgccaacgagctgaactacatcctctgggagaacaacatcaagctgaccgtcgtggtgggggacatcatcggcgtcctggagcagggcaagcggaccctcaccccccagccgatggagctgaagtacagctggaagacgtgggggaaggcgaagatcgtgaccgccgagacccagaactccagcttcatcatcgacggccccaacacccccgagtgcccctccgccagccgcgcctggaacgtgtgggaggtcgaggactacgggttcggcgtgttcacgaccaacatctggctgaagctccgggaggtgtacacccagagctgcgaccaccgcctgatgtccgcggccatcaaggacgagcgggccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccgcccgggctaccacacccagaccgccgggccctggcacctcggcaagctggagctggacttcaactactgcgagggcaccacggtcgtgatcaccgagaactgcgggacccggggccccagcctccgcaccacgaccgtgtccgggaagctgatccacgagtggtgctgccggagctgcaccctgcccccgctccgctacatgggcgaggacgggtgctggtacggcatggagatccggcccatcaacgagaaggaggagaacatggtcaagtccctggtgagcgccggctccgggaaggtggacaacttcaccatgggcgtcctgtgcctcgccatcctgttcgaggaggtgatgcgcgggaagttcggcaagaagcacatgatcgccggggtgctgttcacgttcgtcctcctgctgagcggccagatcacctggcgggacatggcgcacaccctcatcatgatcggctccaacgccagcgaccgcatggggatgggcgtgacctacctggccctgatcgccacgttcaagatccagcccttcctcgccctggggttcttcctgcggaagctcaccagccgcgagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtctccctgacgtgcagcaacaccatcttcaccctgaccgtggcctggcggacggccaccctcatcctggccggggtctccctgctcccgctgtgccagagctccagcatgcgcaagaccgactggctgcccatgaccgtggccgcgatgggcgtgccccccctcccgctgttcatcttctccctgaaggacacgcccaagcgccggagctggcccctcaacgagggggtcatggccgtgggcctggtgtccatcctggccagctccctcctgcgcaacgacgtccccatggccggcccgctggtggccgggggcctcctgatcgcgtgctacgtgatcaccgggaccagcgccgacctgaccgtcgagaaggccgccgacgtgacgtgggaggaggaggccgagcagaccggcgtgtcccacaacctcatgatcaccgtcgacgacgacgggaccatgcggatcaaggacgacgagaccgagaacatcctgacggtgctgctcaagaccgcgctgctgatcgtgagcggcatcttcccctactccatccccgccaccctcctggtctggcacacctggcagaagcagacgcagcgcagcggcgtgctgtgggacgtgccctccccgcccgagacccagaaggccgagctcgaggagggggtctaccggatcaagcagcagggcatcttcgggaagacccaggtgggcgtgggggtccagaaggagggcgtgttccacaccatgtggcacgtgacgcgcggcgccgtcctgacccacaacgggaagcggctggagcccaactgggccagcgtgaagaaggacctcatctcctacggcgggggctggcgcctgagcgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggctccccgatcatcaaccgggagggcaaggtggtcgggctgtacggcaacggggtggtgaccaagaacggcgggtacgtcagcggcatcgcgcagacgaacgccgagcccgacggccccacccccgagctcgaggaggagatgttcaagaagcgcaacctgaccatcatggacctgcacccggggtccggcaagacccggaagtacctccccgccatcgtgcgcgaggccatcaagcggcgcctgcggacgctgatcctcgcccccacccgcgtggtcgcggccgagatggaggaggccctgaaggggctgcccatccggtaccagaccaccgccacgaagagcgagcacaccggccgcgagatcgtggacctcatgtgccacgccaccttcaccatgcggctgctgtccccggtgcgcgtccccaactacaacctcgtgatcatggacgaggcgcacttcacggaccccgccagcatcgccgcccgggggtacatctccacccgcgtgggcatgggcgaggccgcggccatcttcatgaccgccacccccccggggacggccgaggcgttcccccagagcaacgcccccatccaggacgaggagcgcgacatccccgagcggtcctggaacagcggcaacgagtggatcaccgacttcgtcgggaagaccgtgtggttcgtgccgtccatcaaggccggcaacgacatcgccaactgcctgcgcaagaacgggaagaaggtcatccagctgagccggaagaccttcgacacggagtaccagaagacccgcctcaacgactgggacttcgtggtgaccaccgacatctccgagatgggcgccaacttcaaggcggaccgggtcatcgacccccgccggtgcctgaagcccgtgatcctgacggacggccccgagcgcgtgatcctcgccgggccgatgcccgtcaccgccgccagcgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagagccggaagacgttcgtcgagctcatgcgccggggggacctgcccgtgtggctggcccacaaggtggcctccgagggcatcaagtacaccgaccgcaagtggtgcttcgacggggagcggaacaaccagatcctcgaggagaacatggacgtcgagatctggaccaaggagggcgagcgcaagaagctgcgcccgcggtggctggacgcccgcacctacagcgaccccctcgcgctgaaggagttcaaggacttcgccgccggccggaagtccatcgccctggacctcgtgacggagatcgggcgcgtgcccagccacctggcccaccggacccgcaacgcgctggacaacctcgtcatgctgcacaccagcgagcacggcgggcgggcctaccgccacgccgtggaggagctgccggagaccatggagacgctcctgctgctcggcctgatgatcctgctcaccgggggcgccatgctgttcctgatctccggcaaggggatcggcaagaccagcatcgggctcatctgcgtgatcgtctccagcggcatgctgtggatggccgacgtgcccctgcagtggatcgcgtccgccatcgtgctcgagttcttcatgatggtcctgctgatccccgagcccgagaagcagcggaccccgcaggacaaccagctcgcctacgtggtgatcgggatcctgacgctggccgccatcgtcgcggccaacgagatgggcctcctggagaccaccaagcgcgacctgggcatgagcaaggagcccggggtggtgtcccccaccagctacctcgacgtcgacctgcaccccgcctccgcctggacgctgtacgccgtggcgaccaccgtgatcaccccgatgctccggcacacgatcgagaacagcaccgccaacgtctccctggccgccatcgcgaaccaggccgtggtgctgatgggcctcgacaaggggtggcccatcagcaagatggacctgggcgtccccctgctcgccctggggtgctactcccaggtgaaccccctgaccctcaccgccgccgtgctgctgctcgtcacgcactacgcgatcatcggcccgggcctgcaggccaaggccacccgcgaggcccagaagcggaccgccgcggggatcatgaagaaccccaccgtggacggcatcatgacgatcgacctggaccccgtgatctacgacagcaagttcgagaagcagctcgggcaggtcatgctgctggtgctctgcgccgtgcagctgctgctcatgcgcacctcctgggccctgtgcgaggccctgaccctcgccaccggccccatcacgaccctgtgggagggcagcccggggaagttctggaacaccaccatcgcggtctccatggccaacatcttccggggcagctacctggccggggccggcctcgcgttctccatcatgaagagcgtggggacgggccgccggggcaccgggagccagggcgagaccctgggggagaagtggaagaagaagctgaaccagctctcccgcaaggagttcgacctgtacaagaagagcggcatcaccgaggtggaccggaccgaggccaaggaggggctgaagcgcggcgagacgacccaccacgccgtctcccggggcagcgccaagctccagtggttcgtggagcgcaacatggtgatccccgaggggcgcgtcatcgacctgggctgcgggcggggcgggtggtcctactactgcgccggcctgaagaaggtgaccgaggtgcgcggctacaccaaggggggccccgggcacgaggagcccgtcccgatgagcacgtacggctggaacatcgtgaagctcatgtccgggaaggacgtgttctacctgagccccgagaagtgcgacaccctgctgtgcgacatcggcgagtccagcccctcccccaccgtcgaggagagccggaccatccgcgtgctcaagatggtggagccgtggctgcggaacaaccagttctgcatcaaggtcctgaacccctacatgcccacggtgatcgagcacctcgagcgcctgcagcggaagtacggcgggatgctggtgcgcaaccccctctcccggaacagcacccacgagatgtactggatctccaacggcaccgggaacatcgtcagctccgtgaacatggtcagccgcctgctgctcaaccggttcaccatgacgcaccgccggccgaccatcgagaaggacgtggacctgggcgcgggcacccgccacgtgaacgccgagcccgagacccccaacatggacgtcatcggggagcggatcaagcgcatcaaggaggagcactccagcacgtggcactacgacgacgagaacccgtacaagacctgggcctaccacggcagctacgaggtgaaggccaccgggtccgccagctccatgatcaacggcgtggtcaagctgctcaccaagccctgggacgtggtgcccatggtcacgcagatggcgatgaccgacaccacccccttcgggcagcagcgggtgttcaaggagaaggtggacacgcgcaccccgcggcccatgcccggcacccgcaaggtcatggagatcaccgccgagtggctgtggcgcacgctgggccggaacaagaagccccgcctctgcacccgggaggagttcaccaagaaggtgcgcaccaacgccgccatgggggccgtgttcacggaggagaaccagtgggacagcgcgcgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatcccgggcggggccatgtacgccgacgacaccgcgggctgggacacccggatcaccgaggacgacctccacaacgaggagaagatcacgcagcagatggaccccgagcaccgccagctggccaacgccatcttcaagctgacctaccagaacaaggtggtgaaggtccagcggcccacccccaaggggaccgtgatggacatcatctcccgcaaggaccagcggggcagcggccaggtggggacctacggcctcaacacgttcaccaacatggaggcccagctggtccgccagatggagggggagggcgtgctgtccaaggccgacctcgagaacccgcacctgctggagaagaagatcacccagtggctcgagaccaagggggtggagcggctgaagcgcatggcgatcagcggcgacgactgcgtcgtgaagcccatcgacgaccggttcgccaacgccctgctcgccctgaacgacatgggcaaggtgcgcaaggacatcccccagtggcagccctccaaggggtggcacgactggcagcaggtcccgttctgcagccaccacttccacgagctgatcatgaaggacggccgcaagctcgtggtgccctgccggccccaggacgagctgatcgggcgcgcccggatctcccagggcgcggggtggagcctgaaggagacggcctgcctcggcaaggcctacgcccagatgtggtccctgatgtacttccaccgccgggacctgcgcctcgccagcaacgcgatctgcagcgccgtccccgtgcactggatcccgacctcccggaccacctggagcatccacgcccaccaccagtggatgacgaccgaggacatgctgaccgtgtggaaccgcgtctggatcgaggacaacccctggatggaggacaagacccccgtgacgacctgggaggacgtgccctacctgggcaagcgggaggaccagtggtgcgggtccctcatcggcctgaccagccgcgccacctgggcgcagaacatcctgacggccatccagcaggtccggtccctcatcggggacgaggagttcctggactacatgccgagcatgaagcgcttccggaaggaggaggagtccgagggcgccatctggtga

SEQ ID NO: 9969 - RNA, 9873 nt, synthetic construct
  misc_feature 1..9873: note = derived and/or modified CDS sequence (opt1) from DENV-3__KF955333__SS-prME
  source 1..9873: mol_type = other RNA
accagcctgtgcctcatgatgatgctgcccgccaccctggccttccacctcacctcccgcgacggggagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgccatcaactggaagggcaaggagctgaagtgcggctccgggatcttcgtgaccaacgaggtccacacgtggaccgagcagtacaagttccaggcggacagccccaagcgcctggccaccgccatcgccggcgcctgggagaacggggtgtgcggcatccgctccaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggccaagatcgtcaccgccgagacccagaactccagcttcatcatcgacggccccaacacccccgagtgcccctccgccagccgggcgtggaacgtgtgggaggtggaggactacgggttcggcgtcttcacgaccaacatctggctgaagctccgcgaggtgtacacccagagctgcgaccaccggctgatgtccgccgccatcaaggacgagcgcgccgcccacgcggacatgggctactggatcgagagccagaagaacgggtcctggaagctggagaaggccagcttcatcgaggtgaagacctgcacctggccgaagtcccacacgctctggagcaacggcgtcctggagtccgacatgatcatccccaagagcctggccgggcccatctcccagcacaaccaccggccgggctaccacacccagaccgccgggccctggcacctcggcaagctggagctggacttcaactactgcgagggcaccacggtggtgatcaccgagaactgcgggacccgcggccccagcctccggaccacgaccgtctccgggaagctgatccacgagtggtgctgccgcagctgcaccctgcccccgctccggtacatgggcgaggacgggtgctggtacggcatggagatccgccccatcaacgagaaggaggagaacatggtgaagtccctggtgagcgccggctccgggaaggtcgacaacttcaccatgggcgtgctgtgcctcgcgatcctgttcgaggaggtgatgcgggggaagttcggcaagaagcacatgatcgccggggtcctgttcacgttcgtgctcctgctgagcggccagatcacctggcgcgacatggcccacaccctcatcatgatcggctccaacgccagcgaccggatggggatgggcgtgacctacctggccctgatcgcgacgttcaagatccagcccttcctcgccctggggttcttcctgcgcaagctcaccagccgggagaacctgctgctcggcgtcggcctggccatggccaccaccctgcagctccccgaggacatcgagcagatggcgaacgggatcgccctgggcctgatgacgctcaagctgatcacccagttcgagacctaccagctgtggaccgccctcgtgtccctgacgtgcagcaacaccatcttcaccctgaccgtggcctggcgcacggccaccctcatcctggcgggggtctccctgctcccgctgtgccagagctccagcatgcggaagaccgactggctgcccatgaccgtggccgccatgggcgtgccgcccctgccgctgttcatcttctccctgaaggacacgcccaagcgccgcagctggcccctcaacgagggggtgatggccgtgggcctggtctccatcctggccagctccctcctgcggaacgacgtgcccatggcgggcccgctggtggccgggggcctcctgatcgcctgctacgtcatcaccgggaccagcgccgacctgaccgtggagaagcccgccgacgtgccctgggaggaggaggcggagcagacgggcgtctcccacaacctcatgatcaccgtggacgacgacgggcccatgcgcatcaaggacgacgagaccgagaacatcctgaccgtgctgctcaagaccgccctgctgatcgtcagcggcatcttcccgtactccatccccgccacgctcctggtgtggcacacctggcagaagcagacccagcggagcggcgtgctgtgggacgtccccagcccgcccgagacccagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacccacaacgggaagcgcctggagcccaactgggcgagcgtgaagaaggacctcatctcctacggcgggggctggcggctgaacgcccagtggcagaagggggaggaggtccaggtgatcgccgtggagcccggcaagaaccccaagaacttccagacgatgcccggcatcttccagaccaccaccggggagatcggcgccatcgcgctggacttcaagcccgggacgagcggcagccccatcatcaaccgcgagggcaaggtcgtggggctgtacggcaacggggtggtcaccaagaacggcgggtacgtgtccggcatcgcccagaccaacgccgagccggacggccccacccccgagctcgaggaggagatgttcaagaagcggaacctgacgatcatggacctgcaccccgggagcggcaagacccgcaagtacctcccggccatcgtgcgggaggccatcaagcgccggctgcgcaccctgatcctcgcgcccacccgggtcgtggccgccgagatggaggaggccctgaaggggctgcccatccgctaccagacgaccgccaccaagtccgagcacaccggccgggagatcgtggacctcatgtgccacgcgacgttcaccatgcgcctgctgagccccgtccgggtgccgaactacaacctcgtgatcatggacgaggcccacttcaccgaccccgcctccatcgccgcccgcgggtacatcagcacccgggtcggcatgggcgaggcggccgccatcttcatgacggccacgccgcccgggaccgcggaggccttcccgcagtccaacgcccccatccaggacgaggagcgcgacatccccgagcgcagctggaactccggcaacgagtggatcaccgacttcgtggggaagacggtgtggttcgtccccagcatcaaggccggcaacgacatcgccaactgcctgcggaagaacgggaagaaggtgatccagctgtcccgcaagaccttcgacaccgagtaccagaagacccggctcaacgactgggacttcgtggtcacgaccgacatcagcgagatgggcgcgaacttcaaggccgaccgcgtgatcgacccgcggcgctgcctgaagcccgtgatcctgaccgacggccccgagcgggtcatcctcgccgggcccatgccggtgaccgccgcctccgcggcccagcgccggggccgcgtggggcggaacccccagaaggagaacgaccagtacatcttcacgggccagcccctgaacaacgacgaggaccacgcccactggaccgaggccaagatgctgctcgacaacatcaacacccccgaggggatcatcccggccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacaccgaccggaagtggtgcttcgacggggagcgcaacaaccagatcctcgaggagaacatggacgtggagatctggacgaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgcaccgcacccggaacgccctggacaacctcgtgatgctgcacacgagcgagcacggcgggcgcgcctaccggcacgccgtggaggagctgcccgagaccatggagaccctcctgctgctcggcctgatgatcctgctcaccgggggcgccatgctgttcctgatcagcggcaaggggatcggcaagacgtccatcgggctcatctgcgtcatcgtgagctccggcatgctgtggatggcggacgtgccgctgcagtggatcgccagcgccatcgtcctcgagttcttcatgatggtgctgctgatccccgagcccgagaagcagcgcacgccccaggacaaccagctcgcctacgtggtcatcgggatcctgaccctggccgcgatcgtggccgccaacgagatgggcctcctggagaccacgaagcgggacctgggcatgtccaaggagccgggggtggtcagccccacctcctacctcgacgtggacctgcaccccgccagcgcctggaccctgtacgcggtggccaccacggtcatcacccccatgctccgccacaccatcgagaactccaccgccaacgtgagcctggccgcgatcgccaaccaggccgtggtcctgatgggcctcgacaaggggtggccgatctccaagatggacctgggcgtgcccctgctcgccctggggtgctacagccaggtgaaccccctgacgctcaccgccgcggtcctgctgctcgtgacccactacgccatcatcggccccggcctgcaggccaaggccacccgggaggcccagaagcgcacggcggccgggatcatgaagaacccgaccgtggacggcatcatgaccatcgacctggaccccgtcatctacgactccaagttcgagaagcagctcggccaggtgatgctgctggtgctctgcgccgtccagctgctgctcatgcggaccagctgggccctgtgcgaggccctgacgctcgcgaccggccccatcaccaccctgtgggagggctcccccgggaagttctggaacacgaccatcgccgtgagcatggccaacatcttccgcggctcctacctggccggggcgggcctcgccttcagcatcatgaagtccgtggggaccggccggcgcggcaccgggagccagggcgagacgctgggggagaagtggaagaagaagctgaaccagctcagccggaaggagttcgacctgtacaagaagtccggcatcaccgaggtcgaccgcaccgaggccaaggaggggctgaagcggggcgagaccacccaccacgccgtgagccgcggctccgccaagctccagtggttcgtggagcggaacatggtcatcccggaggggcgcgtgatcgacctgggctgcgggcgcggcgggtggagctactactgcgcgggcctgaagaaggtgacggaggtccggggctacaccaagggcgggcccgggcacgaggagcccgtgcccatgtccacctacggctggaacatcgtgaagctcatgagcgggaaggacgtcttctacctgccgcccgagaagtgcgacaccctgctgtgcgacatcggcgagtccagcccctcccccacggtggaggagagccgcaccatccgggtgctcaagatggtcgagccgtggctgcgcaacaaccagttctgcatcaaggtgctgaacccctacatgcccaccgtgatcgagcacctcgagcggctgcagcgcaagtacggcgggatgctggtccggaacccgctctcccgcaacagcacccacgagatgtactggatctccaacggcacggggaacatcgtgagctccgtgaacatggtcagccggctgctgctcaaccgcttcaccatgacccaccggcgccccaccatcgagaaggacgtggacctgggcgccggcacgcggcacgtcaacgccgagcccgagacccccaacatggacgtgatcggggagcgcatcaagcggatcaaggaggagcactccagcacctggcactacgacgacgagaacccgtacaagacctgggcctaccacggctcctacgaggtgaaggccacggggagcgcgagctccatgatcaacggcgtcgtgaagctgctcaccaagccctgggacgtggtccccatggtgacccagatggccatgaccgacacgacccccttcgggcagcagcgcgtgttcaaggagaaggtcgacacccggaccccgcgccccatgcccggcacgcggaaggtgatggagatcaccgccgagtggctgtggcgcaccctgggccgcaacaagaagccccggctctgcacccgcgaggagttcacgaagaaggtgcggaccaacgccgccatgggggcggtcttcaccgaggagaaccagtgggacagcgcccgcgccgccgtggaggacgaggagttctggaagctggtggaccgggagcgcgagctgcacaagctcggcaagtgcgggtcctgcgtctacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatcccgggcggggccatgtacgcggacgacaccgccggctgggacacgcgcatcaccgaggacgacctccacaacgaggagaagatcaccgcccagatggaccccgagcaccggcagctggccaacgccatcttcaagctgacctaccagaacaaggtggtcaaggtgcagcgccccacgcccaaggggaccgtgatggacatcatctcccggaaggaccagcgcggcagcggccaggtcgggacctacggcctcaacaccttcaccaacatggaggcgcagctggtgcggcagatggagggggagggcgtgctgtccaaggccgacctcgagaacccgcacctcctggagaagaagatcacgcagtggctcgagaccaagggggtcgagcgcctgaagcggatggccatcagcggcgacgactgcgtggtgaagcccatcgacgaccgcttcgccaacgccctgctcgcgctgaacgacatgggcaaggtccggaaggacatcccccagtggcagccctccaaggggtggcacgactggcagcaggtcccgttctgcagccaccacttccacgagctgatcatgaaggacggccgcaagctcgtggtcccctgccgcccccaggacgagctgatcgggcgggcccgcatctcccagggcgccgggtggagcctgaaggagaccgcctgcctcggcaaggcctacgcgcagatgtggtccctgatgtacttccaccggcgcgacctgcggctcgccagcaacgccatctgctccgccgtgcccgtgcactggatcccgaccagccgcacgacctggagcatccacgcgcaccaccagtggatgaccaccgaggacatgctgacggtctggaaccgggtgtggatcgaggacaacccctggatggaggacaagacccccgtgaccacctgggaggacgtcccgtacctgggcaagcgcgaggaccagtggtgcgggtccctcatcggcctgacgagccgggccacctgggcccagaacatcctgaccgccatccagcaggtccgctccctcatcggggacgaggagttcctggactacatgcccagcatgaagcggttccgcaaggaggaggagtccgagggcgccatctggtga

SEQ ID NO: 9970 - RNA, 9873 nt, synthetic construct
  misc_feature 1..9873: note = derived and/or modified CDS sequence (opt1) from DENV-3__GQ868628__SS-prME
  source 1..9873: mol_type = other RNA
accagcctgtgcctcatgatgatgctgcccgcgaccctggccttccacctcaccagccgggacggcgagccccggatgatcgtggggaagaacgagcgcggcaagagcctgctgttcaagaccgcgagcgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggcgaagatcgtgaccgccgagacccagaactccagcttcatcatcgacggccccaacacccccgagtgcccctccgccagccgggcctggaacgtgtgggaggtcgaggactacgggttcggcgtgttcacgaccaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcgcgtggccgaagtcccacaccctctggagcaacggcgtgctggagtccgacatgatcatccccaagagcctggccgggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgcgggggtgctgttcaccttcgtcctcctgctgagcggccagatcacgtggcgcgacatggcccacaccctcatcatgatcggctccaacgccagcgaccggatggggatgggcgtgacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtctccctgacctgcagcaacacgatcttcaccctgaccgtggcctggcgcaccgccacgctcatcctggccggggtctccctgctcccgctgtgccagagctccagcatgcggaagaccgactggctgcccatgaccgtggcggccatgggcgtgccgcccctgccgctgttcatcttctccctgaaggacacccccaagcgccgcagctggcccctcaacgagggggtcatggccgtgggcctggtgtccatcctggccagctccctcctgcggaacgacgtccccatggccggcccgctggtggccggcgggctcctgatcgcctgctacgtgatcacggggaccagcgccgacctgaccgtcgagaaggccgccgacgtgacctgggaggaggaggcggagcagacgggggtgtcccacaacctcatgatcaccgtcgacgacgacgggaccatgcgcatcaaggacgacgagaccgagaacatcctgaccgtgctgctcaagacggccctgctgatcgtgagcggcatcttcccctactccatccccgccaccctcctggtctggcacacctggcagaagcagacccagcggagcggcgtgctgtgggacgtgccctccccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggcgagcgtgaagaaggacctcatctcctacggcgggggctggcggctgagcgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggctccccgatcatcaaccgcgagggcaaggtggtcgggctgtacggcaacggggtggtgaccaagaacggcgggtacgtcagcggcatcgcccagaccaacgccgagcccgacggccccacgcccgagctcgaggaggagatgttcaagaagcggaacctgaccatcatggacctgcacccggggtccggcaagacccgcaagtacctccccgccatcgtgcgggaggccatcaagcgccggctgcgcaccctgatcctcgcgcccacgcgggtggtcgccgccgagatggaggaggccctgaaggggctgcccatccgctaccagaccaccgccaccaagagcgagcacacgggccgggagatcgtggacctcatgtgccacgcgaccttcaccatgcgcctgctgtccccggtgcgggtccccaactacaacctcgtgatcatggacgaggcccacttcaccgaccccgccagcatcgccgcccgcgggtacatctccacgcgggtgggcatgggcgaggcggccgccatcttcatgaccgccacgccgcccgggaccgcggaggccttcccccagagcaacgcccccatccaggacgaggagcgcgacatccccgagcgctcctggaacagcggcaacgagtggatcacggacttcgtcgggaagaccgtgtggttcgtgccctccatcaaggccggcaacgacatcgccaactgcctgcggaagaacgggaagaaggtcatccagctgagccgcaagaccttcgacaccgagtaccagaagacgcggctcaacgactgggacttcgtggtgaccaccgacatctccgagatgggcgcgaacttcaaggccgaccgcgtcatcgacccccggcgctgcctgaagcccgtgatcctgaccgacggccccgagcgggtgatcctcgccgggccgatgcccgtcacggccgccagcgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagagccgcaagaccttcgtcgagctcatgcggcgcggggacctgcccgtgtggctggcccacaaggtggcctccgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctacagcgaccccctcgccctgaaggagttcaaggacttcgccgccggccgcaagtccatcgccctggacctcgtgaccgagatcgggcgggtgcccagccacctggcgcaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccgggggcgccatgctgttcctgatctccggcaaggggatcggcaagaccagcatcgggctcatctgcgtgatcgtctccagcggcatgctgtggatggcggacgtgcccctgcagtggatcgcctccgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgagcaaggagcccggggtggtgtcccccaccagctacctcgacgtcgacctgcaccccgcctccgcctggaccctgtacgcggtggccacgaccgtgatcaccccgatgctccgccacaccatcgagaacagcacggccaacgtctccctggccgcgatcgccaaccaggccgtggtgctgatgggcctcgacaaggggtggcccatcagcaagatggacctgggcgtccccctgctcgccctggggtgctactcccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgacagcaagttcgagaagcagctcgggcaggtcatgctgctggtgctctgcgccgtgcagctgctgctcatgcggacgtcctgggccctgtgcgaggccctgaccctcgcgaccggccccatcaccacgctgtgggagggcagcccggggaagttctggaacaccaccatcgccgtctccatggccaacatcttccgcggcagctacctggccggggcgggcctcgccttctccatcatgaagtccgtggggaccggccggcgcggcacggggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagaccacgcaccacgccgtctcccgcggcagcgccaagctccagtggttcgtggagcggaacatggtgatccccgaggggcgcgtcatcgacctgggctgcgggcgcggcgggtggtcctactactgcgcgggcctgaagaaggtgaccgaggtgcggggctacaccaagggcggccccgggcacgaggagcccgtcccgatgagcacctacggctggaacatcgtgaagctcatgtccgggaaggacgtgttctacctgccgcccgagaagtgcgacacgctgctgtgcgacatcggcgagagctcccccagcccgaccgtcgaggagtcccgcaccatccgggtgctcaagatggtggagccctggctgcgcaacaaccagttctgcatcaaggtcctgaacccctacatgcccaccgtgatcgagcacctcgagcggctgcagcgcaagtacggcgggatgctggtgcggaacccgctcagccgcaactccacgcacgagatgtactggatcagcaacggcaccgggaacatcgtctccagcgtgaacatggtctcccggctgctgctcaaccgcttcaccatgacccaccggcgccccacgatcgagaaggacgtggacctgggcgccggcacccggcacgtgaacgccgagcccgagaccccgaacatggacgtcatcggggagcgcatcaagcggatcaaggaggagcacagctccacctggcactacgacgacgagaacccctacaagacgtgggcctaccacggcagctacgaggtgaaggccaccgggagcgcgtccagcatgatcaacggcgtggtcaagctgctcaccaagccctgggacgtggtgcccatggtcacccagatggccatgacggacaccaccccgttcgggcagcagcgcgtgttcaaggagaaggtggacacccggacgccccgccccatgcccggcacccggaaggtcatggagatcaccgccgagtggctgtggcgcaccctgggccgcaacaagaagccgcggctctgcacgcgcgaggagttcaccaagaaggtgcggaccaacgccgccatgggggcggtgttcaccgaggagaaccagtgggactccgcccgcgccgccgtcgaggacgaggagttctggaagctggtggaccgggagcgcgagctgcacaagctcggcaagtgcgggagctgcgtgtacaacatgatgggcaagcgggagaagaagctgggggagttcggcaaggcgaagggctcccgcgccatctggtacatgtggctgggggcccggtacctcgagttcgaggccctgggcttcctgaacgaggaccactggttcagccgcgagaactcctacagcggggtcgagggcgaggggctccacaagctgggctacatcctgcgggacatctccaagatccccggcggggccatgtacgcggacgacacggccggctgggacacccgcatcaccgaggacgacctccacaacgaggagaagatcacccagcagatggaccccgagcaccggcagctggccaacgccatcttcaagctgacgtaccagaacaaggtggtgaaggtccagcgccccaccccgaaggggaccgtgatggacatcatcagccggaaggaccagcgcggctccggccaggtggggacctacggcctcaacaccttcacgaacatggaggcccagctggtccggcagatggagggggagggcgtgctgagcaaggcggacctcgagaacccccacctcctggagaagaagatcacccagtggctcgagaccaagggggtggagcgcctgaagcggatggccatctccggcgacgactgcgtcgtgaagcccatcgacgaccgcttcgccaacgccctgctcgccctgaacgacatgggcaaggtgcggaaggacatcccccagtggcagccgagcaaggggtggcacgactggcagcaggtccccttctgctcccaccacttccacgagctgatcatgaaggacggccgcaagctcgtggtgccctgccgcccccaggacgagctgatcgggcgggcgcgcatcagccagggcgccgggtggtccctgaaggagaccgcctgcctcggcaaggcctacgcccagatgtggagcctgatgtacttccaccggcgcgacctgcggctcgcgtccaacgccatctgcagcgccgtcccggtgcactggatccccacgagccgcaccacctggtccatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcgggagcctcatcggcctgacctcccgggcgacctgggcccagaacatcctgaccgccatccagcaggtccgcagcctcatcggggacgaggagttcctggactacatgccctccatgaagcggttccgcaaggaggaggagagcgagggcgccatctggtga

SEQ ID NO: 9971 - RNA, 9873 nt, synthetic construct
  misc_feature 1..9873: note = derived and/or modified CDS sequence (opt1) from DENV-3__FJ639727__SS-prME
  source 1..9873: mol_type = other RNA
accagcctgtgcctcatgatgatgctgcccgccaccctggccttccacctcaccagccgggacggcgagccgcggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgggacaagcggtccgtcgccctggcgccccacgtgggcatggggctggacacccgcacccagacctggatgagcgccgagggcgcctggcgccaggtggagaaggtcgagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaagtcccacaacggccgcctgatcaccgcgaaccccgtggtcacgaagaaggaggagcccgtgaacatcgaggccgagccgcccttcggggagagcaacatcgtgatcggcatcggggacaaggccctcaagatcaactggtacaagaagggctccagcatcgggaagatgttcgaggccaccgcgcggggcgcccgccggatggccatcctgggcgacaccgcctgggacttcgggtccgtcggcggggtgctgaacagcctcggcaagatggtgcaccagatcttcgggtccgcctacaccgcgctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacgtggaccgagcagtacaagttccaggccgactcccccaagcgcctggccaccgcgatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggccaagatcgtgaccgcggagacccagaacagctccttcatcatcgacggccccaacacccccgagtgccccagcgccagccgggcctggaacgtgtgggaggtcgaggactacgggttcggcgtgttcacgaccaacatctggctgaagctccgcgaggtgtacacccagtcctgcgaccaccggctgatgagcgccgcgatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggccgggcccatcagccagcacaaccaccggccgggctactacacccagaccgcggggccctggcacctcggcaagctggagctggacttcaactactgcgagggcaccacggtcgtgatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggccctgttcacgttcgtgctcctgctgtccggccagatcacctggcgcgacatggcgcacaccctcatcatgatcggcagcaacgccagcgaccggatggggatgggcgtcacctacctggccctgatcgccacgttcaagatccagcccttcctcgccctggggttcttcctgcgcaagctcacctcccgggagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtgagcctgacgtgctccaacaccatcttcaccctgaccgtcgcctggcgcacggccaccctcatcctggccggggtgagcctgctcccgctgtgccagtccagctccatgcggaagaccgactggctgcccatgaccgtcgccgcgatgggcgtgccgcccctgccgctgttcatcttcagcctgaaggacacgcccaagcgccgctcctggcccctcaacgagggggtgatggccgtcggcctggtgagcatcctggcctccagcctcctgcggaacgacgtgcccatggccggcccgctggtcgccgggggcctcctgatcgcgtgctacgtgatcaccgggacctccgccgacctgaccgtggagaaggccgccgacgtcacgtgggaggaggaggccgagcagaccggcgtgagccacaacctcatgatcaccgtggacgacgacgggaccatgcgcatcaaggacgacgagaccgagaacatcctgacggtcctgctcaagaccgcgctgctgatcgtgtccggcatcttcccctacagcatccccgccaccctcctggtgtggcacacctggcagaagcagacgcagcggtccggcgtcctgtgggacgtgcccagcccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagcccaactgggcctccgtcaagaaggacctcatcagctacggcgggggctggcggctgagcgcgcagtggcagaagggggaggaggtccaggtgatcgccgtcgagcccggcaagaacccgaagaacttccagaccatgcccggcatcttccagaccacgaccggggagatcggcgccatcgccctggacttcaagcccgggacctccggcagcccgatcatcaaccgcgagggcaaggtggtggggctgtacggcaacggggtcgtgaccaagaacggcgggtacgtgtccggcatcgcgcagacgaacgccgagcccgacggccccacccccgagctcgaggaggagatgttcaagaagcggaacctgaccatcatggacctgcacccggggagcggcaagacccgcaagtacctccccgccatcgtccgggaggccatcaagcgccggctgcgcacgctgatcctcgcccccacccgggtggtggcggccgagatggaggaggccctgaaggggctgcccatccgctaccagaccaccgccacgaagtccgagcacaccggccgggagatcgtcgacctcatgtgccacgccaccttcaccatgcgcctgctgagcccggtgcgggtgcccaactacaacctcgtcgtgatggacgaggcgcacttcacggaccccgcctccatcgccgcccgcgggtacatcagcacccgggtgggcatgggcgaggccgcggccatcttcatgaccgccacgccgcccgggacggccgaggcgttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgccaactgcctgcggaagaacgggaagaaggtcatccagctgtcccgcaagaccttcgacacggagtaccagaagacccggctcaacgactgggacttcgtggtgaccaccgacatcagcgagatgggcgccaacttccgcgcggaccgggtcatcgacccccgccggtgcctgaagcccgtgatcctgacggacggccccgagcgcgtgatcctcgccgggccgatgcccgtcaccgccgcctccgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagtcccggaagacgttcgtcgagctcatgcgccgcggggacctgcccgtgtggctggcccacaaggtggccagcgagggcatcaagtacaccgaccgcaagtggtgcttcgacggggagcggaacaaccagatcctcgaggagaacatggacgtcgagatctggaccaaggagggcgagcgcaagaagctgcgcccgcggtggctggacgcccgcacctactccgaccccctcgcgctgaaggagttcaaggacttcgccgccggccgcaagagcatcgccctggacctcgtgacggagatcgggcgcgtgcccagccacctggcccaccggacccgcaacgcgctggacaacctcgtcatgctgcacacctccgagcacggcgggcgggcctaccgccacgccgtggaggagctgccggagaccatggagacgctcctgctgctcggcctgatgatcctgctcaccgggggcgccatgctgttcctgatcagcggcaaggggatcggcaagacctccatcgggctcatctgcgtgatcgtcagctccggcatgctgtggatggccgacgtgcccctgcagtggatcgcgagcgccatcgtgctcgagttcttcatgatggtcctgctgatccccgagcccgagaagcagcggaccccgcaggacaaccagctcgcctacgtggtgatcgggatcctgacgctggccgccatcgtcgcggccaacgagatgggcctcctggagaccaccaagcgcgacctgggcatgtccaaggagcccggggtggtgagccccacctcctacctcgacgtcgacctgcaccccgccagcgcctggacgctgtacgccgtggcgaccaccgtgatcaccccgatgctccggcacacgatcgagaactccaccgccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacgcactacgcgatcatcggcccgggcctgcaggccaaggccacccgcgaggcccagaagcggaccgccgcggggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcgcaccagctgggccctgtgcgaggccctgaccctcgccaccggccccatcacgaccctgtgggagggctccccggggaagttctggaacaccaccatcgcggtcagcatggccaacatcttccggggctcctacctggccggggccggcctcgcgttcagcatcatgaagtccgtggggacgggccgccggggcaccgggtcccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagacgacccaccacgccgtcagccggggctccgccaagctccagtggttcgtggagcgcaacatggtgatccccgaggggcgcgtcatcgacctgggctgcgggcggggcgggtggagctactactgcgccggcctgaagaaggtgaccgaggtgcgcggctacaccaagggcgggcccgggcacgaggagcccgtcccgatgtccacgtacggctggaacatcgtgaagctcatgagcgggaaggacgtgttctacctgccgcccgagaagtgcgacaccctgctgtgcgacatcggcgagtccagcccctccccgaccgtcgaggagagccggaccatccgcgtgctcaagatggtggagccctggctgcggaacaaccagttctgcatcaaggtcctgaacccctacatgcccacggtgatcgagcacctcgagcgcctgcagcggaagtacggcgggatgctggtgcgcaacccgctctcccggaacagcacccacgagatgtactggatctccaacggcaccgggaacatcgtcagctccgtgaacatggtcagccgcctgctgctcaaccggttcaccatgacgcaccgccggcccaccatcgagaaggacgtggacctgggcgcgggcacccgccacgtgaacgccgagcccgagaccccgaacatggacgtcatcggggagcggatcaagcgcatcaaggaggagcactccagcacgtggcactacgacgacgagaacccctacaagacctgggcctaccacggcagctacgaggtgaaggccaccgggtccgccagctccatgatcaacggcgtggtcaagctgctcaccaagccctgggacgtggtgcccatggtcacgcagatggcgatgaccgacaccaccccgttcgggcagcagcgggtgttcaaggagaaggtggacacgcgcacgccccggcccatgcccggcacccgcaaggtcatggagatcaccgccgagtggctgtggcgcacgctgggccggaacaagaagccgcgcctctgcacccgggaggagttcaccaagaaggtgcgcaccaacgccgccatgggggccgtgttcacggaggagaaccagtgggacagcgcgcgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgccgacgacaccgcgggctgggacacccggatcaccgaggacgacctccacaacgaggagaagatcacgcagcagatggaccccgagcaccgccagctggccaacgccatcttcaagctgacctaccagaacaaggtggtgaaggtccagcggcccaccccgaaggggaccgtgatggacatcatctcccgcaaggaccagcggggcagcggccaggtggggacctacggcctcaacacgttcaccaacatggaggcccagctggtccgccagatggagggggagggcgtgctgtccaaggccgacctcgagaacccccacctcctggagaagaagatcacccagtggctcgagaccaagggggtggagcggctgaagcgcatggcgatcagcggcgacgactgcgtcgtgaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccgcaagctcgtggtgccctgccggccccaggacgagctgatcgggcgcgcccggatctcccagggcgcggggtggagcctgaaggagacggcctgcctcggcaaggcctacgcccagatgtggtccctgatgtacttccaccgccgggacctgcgcctcgccagcaacgcgatctgcagcgccgtcccggtgcactggatccccacctcccggaccacctggagcatccacgcccaccaccagtggatgacgaccgaggacatgctgaccgtgtggaaccgcgtctggatcgaggacaacccctggatggaggacaagacccccgtgacgacctgggaggacgtgccgtacctgggcaagcgggaggaccagtggtgcgggtccctcatcggcctgaccagccgcgccacctgggcgcagaacatcctgacggccatccagcaggtccggtccctcatcggggacgaggagttcctggactacatgcccagcatgaagcgcttccggaaggaggaggagtccgagggcgccatctggtga

SEQ ID NO: 9972 - RNA, 9873 nt, synthetic construct
  misc_feature 1..9873: note = derived and/or modified CDS sequence (opt1) from DENV-3__GQ868629__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgagcgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccatcaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagtccaacatcgtgatcggcatcggggacaaggccctcaagatcaactggtacaagaagggcagctccatcgggaagatgttcgaggcgacggcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacctggacggagcagtacaagttccaggccgacagccccaagcgcctggcgaccgccatcgccggcgcctgggagaacggggtgtgcggcatccgctccaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtacagctggaagacctgggggaaggcgaagatcgtgacggccgagacccagaactccagcttcatcatcgacggccccaacacccccgagtgcccctccgccagccgggcctggaacgtgtgggaggtcgaggactacgggttcggcgtgttcaccacgaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcaccttcgtcctcctgctgagcggccagatcacgtggcgcgacatggcgcacaccctcatcatgatcggctccaacgccagcgaccggatggggatgggcgtgacctacctggccctgatcgccaccttcaagatccagcccttcctcgccctggggttcttcctgcgcaagctcacgagccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtctccctgacctgcagcaacacgatcttcaccctgaccgtggcctggcgcaccgccacgctcatcctggccggggtctccctgctcccgctgtgccagagctccagcatgcggaagaccgactggctgcccatgaccgtggccgcgatgggcgtgccgcccctgccgctgttcatcttctccctgaaggacacccccaagcgccgcagctggcccctcaacgagggggtcatggccgtgggcctggtgtccatcctggccagctccctcctgcggaacgacgtccccatggccggcccgctggtggccgggggcctcctgatcgcgtgctacgtgatcacggggaccagcgccgacctgaccgtcgagaaggccgccgacgtgacctgggaggaggaggccgagcagacgggcgtgtcccacaacctcatgatcaccgtcgacgacgacgggaccatgcgcatcaaggacgacgagaccgagaacatcctgaccgtgctgctcaagacggcgctgctgatcgtgagcggcatcttcccctactccatccccgccaccctcctggtctggcacacctggcagaagcagacccagcggagcggcgtgctgtgggacgtgccctccccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggccagcgtgaagaaggacctcatctcctacggcgggggctggcggctgagcgcgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggaccagcggctccccgatcatcaaccgcgagggcaaggtggtcgggctgtacggcaacggggtggtgaccaagaacggcgggtacgtcagcggcatcgcgcagaccaacgccgagcccgacggccccacgcccgagctcgaggaggagatgttcaagaagcggaacctgaccatcatggacctgcacccggggtccggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagagcgagcacacgggccgggagatcgtggacctcatgtgccacgccaccttcaccatgcgcctgctgtccccggtgcgggtccccaactacaacctcgtgatcatggacgaggcgcacttcaccgaccccgccagcatcgccgcccgcgggtacatctccacgcgggtgggcatgggcgaggccgcggccatcttcatgaccgccacgccgcccgggaccgccgaggcgttcccccagagcaacgcccccatccaggacgaggagcgcgacatccccgagcgctcctggaacagcggcaacgagtggatcacggacttcgtcgggaagaccgtgtggttcgtgccctccatcaaggccggcaacgacatcgccaactgcctgcggaagaacgggaagaaggtcatccagctgagccgcaagaccttcgacaccgagtaccagaagacgcggctcaacgactgggacttcgtggtgaccaccgacatctccgagatgggcgccaacttcaaggcggaccgcgtcatcgacccccggcgctgcctgaagcccgtgatcctgaccgacggccccgagcgggtgatcctcgccgggccgatgcccgtcacggccgccagcgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagagccgcaagaccttcgtcgagctcatgcggcgcggggacctgcccgtgtggctggcccacaaggtggcctccgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcccggacctacagcgaccccctcgcgctgaaggagttcaaggacttcgccgccggccgcaagtccatcgccctggacctcgtgaccgagatcgggcgggtgcccagccacctggcccaccgcacgcggaacgcgctggacaacctcgtcatgctgcacaccagcgagcacggcgggcgcgcctaccggcacgccgtggaggagctgccggagaccatggagaccctcctgctgctcggcctgatgatcctgctcaccggcggggccatgctgttcctgatctccgggaaggggatcggcaagaccagcatcgggctcatctgcgtgatcgtctccagcggcatgctgtggatggccgacgtgcccctgcagtggatcgcgtccgccatcgtgctcgagttcttcatgatggtcctgctgatccccgagcccgagaagcagcgcaccccgcaggacaaccagctcgcctacgtggtgatcgggatcctgaccctggccgccatcgtcgcggccaacgagatgggcctcctggagacgaccaagcgggacctgggcatgagcaaggagcccggggtggtgtcccccaccagctacctcgacgtcgacctgcaccccgcctccgcctggaccctgtacgccgtggcgacgaccgtgatcaccccgatgctccgccacaccatcgagaacagcacggccaacgtctccctggccgccatcgcgaaccaggccgtggtgctgatgggcctcgacaaggggtggcccatcagcaagatggacctgggcgtccccctgctcgccctggggtgctactcccaggtgaaccccctgaccctcaccgccgccgtgctgctgctcgtcacccactacgcgatcatcggcccgggcctgcaggccaaggccacgcgggaggcccagaagcgcaccgccgcggggatcatgaagaaccccaccgtggacggcatcatgaccatcgacctggaccccgtgatctacgacagcaagttcgagaagcagctcgggcaggtcatgctgctggtgctctgcgccgtgcagctgctgctcatgcggacgtcctgggccctgtgcgaggccctgaccctcgccaccggccccatcaccacgctgtgggagggcagcccggggaagttctggaacaccaccatcgcggtctccatggccaacatcttccgcggcagctacctggccggggccggcctcgcgttctccatcatgaagtccgtggggaccggccggcgcggcacggggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagaccacgcaccacgccgtctcccgcggcagcgccaagctccagtggttcgtggagcggaacatggtgatccccgaggggcgcgtcatcgacctgggctgcgggcgcggcgggtggtcctactactgcgccggcctgaagaaggtgaccgaggtgcggggctacaccaagggcggccccgggcacgaggagcccgtcccgatgagcacctacggctggaacatcgtgaagctcatgtccgggaaggacgtgttctacctgccgcccgagaagtgcgacacgctgctgtgcgacatcggcgagagctcccccagcccgaccgtcgaggagtcccgcaccatccgggtgctcaagatggtggagccctggctgcgcaacaaccagttctgcatcaaggtcctgaacccctacatgcccaccgtgatcgagcacctcgagcggctgcagcgcaagtacggcgggatgctggtgcggaacccgctcagccgcaactccacgcacgagatgtactggatcagcaacggcaccgggaacatcgtctccagcgtgaacatggtctcccggctgctgctcaaccgcttcaccatgacccaccggcgccccacgatcgagaaggacgtggacctgggcgcgggcacccggcacgtgaacgccgagcccgagaccccgaacatggacgtcatcggggagcgcatcaagcggatcaaggaggagcacagctccacctggcactacgacgacgagaacccctacaagacgtgggcctaccacggcagctacgaggtgaaggccaccgggagcgcctccagcatgatcaacggcgtggtcaagctgctcaccaagccctgggacgtggtgcccatggtcacccagatggcgatgacggacaccaccccgttcgggcagcagcgcgtgttcaaggagaaggtggacacccggacgccccgccccatgcccggcacccggaaggtcatggagatcaccgccgagtggctgtggcgcaccctgggccgcaacaagaagccgcggctctgcacgcgcgaggagttcaccaagaaggtgcggaccaacgccgccatgggggccgtgttcaccgaggagaaccagtgggactccgcgcgcgccgccgtcgaggacgaggagttctggaagctggtggaccgggagcgcgagctgcacaagctcggcaagtgcgggagctgcgtgtacaacatgatgggcaagcgggagaagaagctgggggagttcggcaaggccaagggctcccgcgcgatctggtacatgtggctgggggcccggtacctcgagttcgaggccctgggcttcctgaacgaggaccactggttcagccgcgagaactcctacagcggggtcgagggcgaggggctccacaagctgggctacatcctgcgggacatctccaagatccccggcggggccatgtacgccgacgacacggcgggctgggacacccgcatcaccgaggacgacctccacaacgaggagaagatcacccagcagatggaccccgagcaccggcagctggccaacgccatcttcaagctgacgtaccagaacaaggtggtgaaggtccagcgccccaccccgaaggggaccgtgatggacatcatcagccggaaggaccagcgcggctccggccaggtggggacctacggcctcaacaccttcacgaacatggaggcccagctggtccggcagatggagggggagggcgtgctgagcaaggccgacctcgagaacccccacctcctggagaagaagatcacccagtggctcgagaccaagggggtggagcgcctgaagcggatggcgatctccggcgacgactgcgtcgtgaagcccatcgacgaccgcttcgccaacgccctgctcgccctgaacgacatgggcaaggtgcggaaggacatcccccagtggcagccgagcaaggggtggcacgactggcagcaggtccccttctgctcccaccacttccacgagctgatcatgaaggacggccgcaagctcgtggtgccctgccgcccccaggacgagctgatcgggcgggcccgcatcagccagggcgcggggtggtccctgaaggagaccgcctgcctcggcaaggcctacgcccagatgtggagcctgatgtacttccaccggcgcgacctgcggctcgcctccaacgcgatctgcagcgccgtcccggtgcactggatccccacgagccgcaccacctggtccatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcgggagcctcatcggcctgacctcccgggccacctgggcgcagaacatcctgaccgccatccagcaggtccgcagcctcatcggggacgaggagttcctggactacatgccctccatgaagcggttccgcaaggaggaggagagcgagggcgccatctggtga

SEQ ID NO: 9973 - RNA, 9873 nt, synthetic construct
  misc_feature 1..9873: note = derived and/or modified CDS sequence (opt1) from DENV-3__FJ639728__SS-prME
  source 1..9873: mol_type = other RNA
accagcctgtgcctcatgatgatgctgcccgccaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcgcctggcgaccgccatcgccggcgcctgggagaacggggtgtgcggcatccgctccaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggcgaagatcgtgaccgccgagacccagaactccagcttcatcatcgacggccccaacacccccgagtgcccctccgccctgcgggcctggaacgtgtgggaggtcgaggactacgggttcggcgtgttcacgaccaacatctggctcaagctgcgcgaggtgtacacccagagctgcgaccaccggctgatgagcgcggccatcaaggacgagcgcgccgtccacgccgacatgggctactggatcgagtcccagaagaacgggagctggaagctcgagaaggcctccttcatcgaggtgaagacctgcacctggcccaagagccacacgctgtggtccaacggcgtgctggagagcgacatgatcatccccaagtccctcgcggggcccatcagccagcacaaccaccggccgggctaccacacccagaccgccgggccctggcacctgggcaagctggagctcgacttcaactactgcgagggcaccacggtcgtgatcaccgagaactgcgggacccgcggcccctccctgcggaccacgaccgtgagcgggaagctgatccacgagtggtgctgccgctcctgcaccctgccgcccctgcggtacatgggcgaggacgggtgctggtacggcatggagatccgccccatcaacgagaaggaggagaacatggtcaagagcctggtgtccgccggcagcgggaaggtggacaacttcaccatgggcgtcctctgcctggccatcctgttcgaggaggtgatgcgggggaagttcggcaagaagcacatgatcgccggggtcctgttcacgttcgtcctgctgctctccggccagatcacctggcgcgacatggcgcacaccctgatcatgatcggcagcaacgcctccgaccggatggggatgggcgtgacctacctggccctcatcgccacgttcaagatccagcccttcctggccctggggttcttcctccgcaagctgaccagccgggagaacctgctcctgggcgtgggcctggcgatggccaccaccctccagctgcccgaggacatcgagcagatggccaacgggatcgccctgggcctcatgacgctgaagctgatcacccagttcgagacctaccagctctggaccgcgctggtcagcctgacgtgctccaacaccatcttcaccctcaccgtggcctggcgcacggccaccctgatcctggccggggtcagcctcctgcccctgtgccagtccagctccatgcggaagaccgactggctccccatgaccgtggccgcgatgggcgtgccgcccctcccgctgttcatcttcagcctcaaggacacgcccaagcgccgctcctggcccctgaacgagggggtcatggccgtgggcctggtgagcatcctcgcctccagcctgctgcggaacgacgtccccatggccggcccgctcgtggccgggggcctgctgatcgcgtgctacgtgatcaccgggacctccgccgacctcaccgtcgagaaggccgccgacgtgacgtgggaggaggaggccgagcagaccggcgtgagccacaacctgatgatcaccgtcgacgacgacgggaccatgcgcatcaaggacgacgagaccgagaacatcctgacggtgctcctgaagaccgcgctgctcatcgtgtccggcatcttcccctacagcatccccgccaccctgctggtctggcacacctggcagaagcagacgcagcggtccggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgccgtcctgacccacaacgggaagcgcctcgagcccaactgggcctccgtgaagaaggacctgatcagctacggcgggggctggcggctgtccgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggcagcccgatcatcaaccgcgagggcaaggtggtcgggctctacggcaacggggtggtgaccaagaacggcgggtacgtctccggcatcgcgcagacgaacgccgagcccgacggccccacccccgagctggaggaggagatgttcaagaagcggaacctgaccatcatggacctccacccggggagcggcaagacccgcaagtacctgcccgccatcgtgcgggaggccatcaagcgccggctgcgcacgctcatcctggcccccacccgggtggtcgcggccgagatggaggaggccctgaaggggctccccatccgctaccagaccaccgccacgaagtccgagcacaccggccgggagatcgtggacctgatgtgccacgccaccttcaccatgcgcctgctcagcccggtgcgggtccccaactacaacctggtgatcatggacgaggcgcacttcacggaccccgcctccatcgccgcccgcgggtacatcagcacccgggtgggcatgggcgaggccgcggccatcttcatgaccgccacgcccccggggacggccgaggcgttcccccagtccaacgcccccatccaggacgaggagcgcgacatccccgagcgcagctggaactccggcaacgagtggatcaccgacttcgtcgggaagaccgtgtggttcgtgccgagcatcaaggccggcaacgacatcgccaactgcctgcggaagaacgggaagaaggtcatccagctctcccgcaagaccttcgacacggagtaccagaagacccggctgaacgactgggacttcgtggtgaccaccgacatcagcgagatgggcgccaacttcaaggcggaccgcgtcatcgacccccggcgctgcctgaagcccgtgatcctcacggacggccccgagcgggtgatcctggccgggccgatgcccgtcaccgccgcctccgccgcgcagcgccggggccgcgtggggcggaacccccagaaggagaacgaccagtacatcttcaccggccagcccctgaacaacgacgaggaccacgcccactggaccgaggccaagatgctcctggacaacatcaacaccccggaggggatcatccccgccctgttcgagcccgagcgcgagaagtccgccgcgatcgacggcgagtaccggctcaagggcgagtcccgcaagacgttcgtcgagctgatgcggcgcggggacctgcccgtgtggctcgcccacaaggtggccagcgagggcatcaagtacaccgaccggaagtggtgcttcgacggggagcgcaacaaccagatcctggaggagaacatggacgtcgagatctggaccaaggagggcgagcggaagaagctgcgcccgcgctggctcgacgcccggacctactccgaccccctggcgctgaaggagttcaaggacttcgccgccggccgcaagagcatcgccctcgacctggtgacggagatcgggcgggtgccctcccacctggcccaccgcacccggaacgcgctcgacaacctggtcatgctgcacaccagcgagcacggcgggcgcgcctaccggcacgccgtggaggagctcccggagaccatggagacgctgctgctcctgggcctgatgatcctcctgaccgggggcgccatgctgttcctcatcagcggcaaggggatcggcaagacctccatcgggctgatctgcgtgatcgtcagctccggcatgctgtggatggccgacgtgcccctccagtggatcgcgagcgccatcgtgctggagttcttcatgatggtcctgctcatccccgagcccgagaagcagcgcaccccgcaggacaaccagctggcctacgtggtgatcgggatcctgacgctcgccgccatcgtcgcggccaacgagatgggcctgctggagaccaccaagcgggacctcggcatgtccaaggagcccggggtggtgagccccacctcctacctggacgtcgacctgcaccccgccagcgcctggacgctctacgccgtggcgaccaccgtgatcaccccgatgctgcgccacacgatcgagaactccaccgccaacgtcagcctggccgccatcgcgaaccaggccgtggtgctcatgggcctggacaaggggtggcccatctccaagatggacctgggcgtccccctcctggccctggggtgctacagccaggtgaaccccctcaccctgaccgccgccgtgctgctcctggtcacgcactacgcgatcatcggcccgggcctgcaggccaaggccacccgggaggcccagaagcgcaccgccgcggggatcatgaagaaccccaccgtggacggcatcatgacgatcgacctcgaccccgtgatctacgactccaagttcgagaagcagctggggcaggtcatgctgctcgtgctgtgcgccgtgcagctgctcctgatgcggaccagctgggccctgtgcgaggccctcaccctggccaccggccccatcacgaccctgtgggagggctccccggggaagttctggaacaccaccatcgcggtcagcatggccaacatcttccgcggctcctacctcgccggggccggcctggcgttcagcatcatgaagtccgtggggacgggccggcgcggcaccgggagccagggcgagaccctgggggagaagtggaagaagaagctcaaccagctgagccggaaggagttcgacctgtacaagaagtccggcatcaccgaggtggaccgcaccgaggccaaggaggggctcaagcggggcgagacgacccaccacgccgtcagccgcggctccgccaagctgcagtggttcgtggagcggaacatggtgatccccgaggggcgcgtcatcgacctgggctgcgggcgcggcgggtggagctactactgcgccggcctcaagaaggtgaccgaggtgcggggctacaccaagggcgggcccgggcacgaggagcccgtcccgatgtccacgtacggctggaacatcgtgaagctgatgagcgggaaggacgtgttctacctgccgcccgagaagtgcgacaccctgctctgcgacatcggcgagtccagcccctccccgaccgtcgaggagagccgcaccatccgggtgctgaagatggtggagccctggctgcgcaacaaccagttctgcatcaaggtcctcaacccctacatgcccacggtgatcgagcacctggagcggctgcagcgcaagtacggcgggatgctcgtgcggaacccgctgtcccgcaacagcacccacgagatgtactggatctccaacggcaccgggaacatcgtcagctccgtgaacatggtcagccggctgctcctgaaccgcttcaccatgacgcaccggcgccccaccatcgagaaggacgtggacctgggcgcgggcacccggcacgtgaacgccgagcccgagaccccgaacatggacgtcatcggggagcgcatcaagcggatcaaggaggagcactccagcacgtggcactacgacgacgagaacccctacaagacctgggcctaccacggctcctacgaggtgaaggccaccgggagcgccagctccatgatcaacggcgtggtcaagctcctgaccaagccctgggacgtggtgcccatggtcacgcagatggcgatgaccgacaccaccccgttcgggcagcagcgcgtgttcaaggagaaggtggacacgcggacgccccggcccatgcccggcacccggaaggtcatggagatcaccgccgagtggctgtggcgcacgctcggccgcaacaagaagccgcggctgtgcacccgcgaggagttcaccaagaaggtgcggaccaacgccgccatgggggccgtgttcacggaggagaaccagtgggacagcgcgcgcgccgccgtcgaggacgaggagttctggaagctggtggaccgggagcgcgagctccacaagctgggcaagtgcgggtcctgcgtgtacaacatgatgggcaagcgggagaagaagctgggggagttcggcaaggccaagggcagccgcgcgatctggtacatgtggctcggggcccggtacctggagttcgaggccctgggcttcctcaacgaggaccactggttctcccgcgagaacagctactccggggtcgagggcgaggggctgcacaagctgggctacatcctccgggacatcagcaagatccccggcggggccatgtacgccgacgacaccgcgggctgggacacccgcatcaccgaggacgacctgcacaacgaggagaagatcacgcagcagatggaccccgagcaccggcagctggccaacgccatcttcaagctcacctaccagaacaaggtggtgaaggtccagcgccccaccccgaaggggaccgtgatggacatcatctcccggaaggaccagcgcggcagcggccaggtggggacctacggcctgaacacgttcaccaacatggaggcccagctggtccggcagatggagggggagggcgtgctctccaaggccgacctggagaacccccacctcctcgagaagaagatcacccagtggctggagaccaagggggtggagcgcctgaagcggatggcgatcagcggcgacgactgcgtcgtgaagcccatcgacgaccgcttcgccaacgccctcctggccctgaacgacatgggcaaggtgcggaaggacatcccccagtggcagccgtccaaggggtggcacgactggcagcaggtccccttctgcagccaccacttccacgagctcatcatgaaggacggccgcaagctggtggtgccctgccgcccccaggacgagctgatcgggcgggcccgcatctcccagggcgcggggtggagcctcaaggagacggcctgcctgggcaaggcctacgcccagatgtggtccctgatgtacttccaccggcgcgacctccggctggccagcaacgcgatctgctccgccgtcccggtgcactggatccccaccagccgcaccacctggagcatccacgcccaccaccagtggatgacgaccgaggacatgctgaccgtgtggaaccgggtctggatcgaggacaacccctggatggaggacaagacccccgtgacgacctgggaggacgtgccgtacctcggcaagcgcgaggaccagtggtgcgggtccctgatcggcctgaccagccgggccacctgggcgcagaacatcctcacggccatccagcaggtccgctccctgatcggggacgaggagttcctggactacatgcccagcatgaagcggttccgcaaggaggaggagtccgagggcgccatctggtga

SEQ ID NO: 9974 - RNA, 9873 nt, synthetic construct
  misc_feature 1..9873: note = derived and/or modified CDS sequence (opt1) from DENV-3__FJ639729__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgagcgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccatcaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagtccaacatcgtgatcggcatcggggacaaggccctcaagatcaactggtacaagaagggcagctccatcgggaagatgttcgaggcgacggcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacctggatcggcctgaactccaagaacacgagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacctggacggagcagtacaagttccaggccgacagccccaagcgcctggcgaccgccatcgccggcgcctgggagaacggggtgtgcggcatccgctccaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtacagctggaagacctgggggaaggcgaagatcgtgacggccgagacccagaactccagcttcatcatcgacggccccaacacccccgagtgcccctccgccagccgggcctggaacgtgtgggaggtcgaggactacgggttcggcgtgttcaccacgaacatctggctgaagctccgcgaggtgtacacccagagctgcgaccaccggctgatgtccgcggccatcaaggacgagcgcgccgtccacgccgacatgggctactggatcgagagccagaagaacgggtcctggaagctggagaaggccagcttcatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcaccttcgtcctcctgctgagcggccagatcacgtggcgcgacatggcgcacaccctcatcatgatcggctccaacgccagcgaccggatggggatgggcgtgacctacctggccctgatcgccaccttcaagatccagcccttcctcgccctggggttcttcctgcgcaagctcacgagccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtctccctgacctgcagcaacacgatcttcaccctgaccgtggcctggcgcaccgccacgctcatcctggccggggtctccctgctcccgctgtgccagagctccagcatgcggaagaccgactggctgcccatgaccgtggccgcgatgggcgtgccgcccctgccgctgttcatcttctccctgaaggacacccccaagcgccgcagctggcccctcaacgagggggtcatggccgtgggcctggtgtccatcctggccagctccctcctgcggaacgacgtccccatggccggcccgctggtggccgggggcctcctgatcgcgtgctacgtgatcacggggaccagcgccgacctgaccgtcgagaaggccgccgacgtgacctgggaggaggaggccgagcagacgggcgtgtcccacaacctcatgatcaccgtcgacgacgacgggaccatgcgcatcaaggacgacgagaccgagaacatcctgaccgtgctgctcaagacggcgctgctgatcgtgagcggcatcttcccctactccatccccgccaccctcctggtctggcacacctggcagaagcagacccagcggagcggcgtgctgtgggacgtgccctccccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggccagcgtgaagaaggacctcatctcctacggcgggggctggcggctgagcgcgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggaccagcggctccccgatcatcaaccgcgagggcaaggtggtcgggctgtacggcaacggggtggtgaccaagaacggcgggtacgtcagcggcatcgcgcagaccaacgccgagcccgacggccccacgcccgagctcgaggaggagatgttcaagaagcggaacctgaccatcatggacctgcacccggggtccggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagagcgagcacacgggccgggagatcgtggacctcatgtgccacgccaccttcaccatgcgcctgctgtccccggtgcgggtccccaactacaacctcgtgatcatggacgaggcgcacttcaccgaccccgccagcatcgccgcccgcgggtacatctccacgcgggtgggcatgggcgaggccgcggccatcttcatgaccgccacgccgcccgggaccgccgaggcgttcccccagagcaacgcccccatccaggacgaggagcgcgacatccccgagcgctcctggaacagcggcaacgagtggatcacggacttcgtcgggaagaccgtgtggttcgtgccctccatcaaggccggcaacgacatcgccaactgcctgcggaagaacgggaagaaggtcatccagctgagccgcaagaccttcgacaccgagtaccagaagacgcggctcaacgactgggacttcgtggtgaccaccgacatctccgagatgggcgccaacttcaaggcggaccgcgtcatcgacccccggcgctgcctgaagcccgtgatcctgaccgacggccccgagcgggtgatcctcgccgggccgatgcccgtcacggccgccagcgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagagccgcaagaccttcgtcgagctcatgcggcgcggggacctgcccgtgtggctggcccacaaggtggcctccgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcccggacctacagcgaccccctcgcgctgaaggagttcaaggacttcgccgccggccgcaagtccatcgccctggacctcgtgaccgagatcgggcgggtgcccagccacctggcccaccgcacgcggaacgcgctggacaacctcgtcatgctgcacaccagcgagcacggcgggcgcgcctaccggcacgccgtggaggagctgccggagaccatggagaccctcctgctgctcggcctgatgatcctgctcaccggcggggccatgctgttcctgatctccgggaaggggatcggcaagaccagcatcgggctcatctgcgtgatcgtctccagcggcatgctgtggatggccgacgtgcccctgcagtggatcgcgtccgccatcgtgctcgagttcttcatgatggtcctgctgatccccgagcccgagaagcagcgcaccccgcaggacaaccagctcgcctacgtggtgatcgggatcctgaccctggccgccatcgtcgcggccaacgagatgggcctcctggagacgaccaagcgggacctgggcatgagcaaggagcccggggtggtgtcccccaccagctacctcgacgtcgacctgcaccccgcctccgcctggaccctgtacgccgtggcgacgaccgtgatcaccccgatgctccgccacaccatcgagaacagcacggccaacgtctccctggccgccatcgcgaaccaggccgtggtgctgatgggcctcgacaaggggtggcccatcagcaagatggacctgggcgtccccctgctcgccctggggtgctactcccaggtgaaccccctgaccctcaccgccgccgtgctgctgctcgtcacccactacgcgatcatcggcccgggcctgcaggccaaggccacgcgggaggcccagaagcgcaccgccgcggggatcatgaagaaccccaccgtggacggcatcatgaccatcgacctggaccccgtgatctacgacagcaagttcgagaagcagctcgggcaggtcatgctgctggtgctctgcgccgtgcagctgctgctcatgcggacgtcctgggccctgtgcgaggccctgaccctcgccaccggccccatcaccacgctgtgggagggcagcccggggaagttctggaacaccaccatcgcggtctccatggccaacatcttccgcggcagctacctggccggggccggcctcgcgttctccatcatgaagtccgtggggaccggccggcgcggcacggggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagaccacgcaccacgccgtctcccgcggcagcgccaagctccagtggttcgtggagcggaacatggtgatccccgaggggcgcgtcatcgacctgggctgcgggcgcggcgggtggtcctactactgcgccggcctgaagaaggtgaccgaggtgcggggctacaccaagggcggccccgggcacgaggagcccgtcccgatgagcacctacggctggaacatcgtgaagctcatgtccgggaaggacgtgttctacctgccgcccgagaagtgcgacacgctgctgtgcgacatcggcgagagctcccccagcccgaccgtcgaggagtcccgcaccatccgggtgctcaagatggtggagccctggctgcgcaacaaccagttctgcatcaaggtcctgaacccctacatgcccaccgtgatcgagcacctcgagcggctgcagcgcaagtacggcgggatgctggtgcggaacccgctcagccgcaactccacgcacgagatgtactggatcagcaacggcaccgggaacatcgtctccagcgtgaacatggtctcccggctgctgctcaaccgcttcaccatgacccaccggcgccccacgatcgagaaggacgtggacctgggcgcgggcacccggcacgtgaacgccgagcccgagaccccgaacatggacgtcatcggggagcgcatcaagcggatcaaggaggagcacagctccacctggcactacgacgacgagaacccctacaagacgtgggcctaccacggcagctacgaggtgaaggccaccgggagcgcctccagcatgatcaacggcgtggtcaagctgctcaccaagccctgggacgtggtgcccatggtcacccagatggcgatgacggacaccaccccgttcgggcagcagcgcgtgttcaaggagaaggtggacacccggacgccccgccccatgcccggcacccggaaggtcatggagatcaccgccgagtggctgtggcgcaccctgggccgcaacaagaagccgcggctctgcacgcgcgaggagttcaccaagaaggtgcggaccaacgccgccatgggggccgtgttcaccgaggagaaccagtgggactccgcgcgcgccgccgtcgaggacgaggagttctggaagctggtggaccgggagcgcgagctgcacaagctcggcaagtgcgggagctgcgtgtacaacatgatgggcaagcgggagaagaagctgggggagttcggcaaggccaagggctcccgcgcgatctggtacatgtggctgggggcccggtacctcgagttcgaggccctgggcttcctgaacgaggaccactggttcagccgcgagaactcctacagcggggtcgagggcgaggggctccacaagctgggctacatcctgcgggacatctccaagatccccggcggggccatgtacgccgacgacacggcgggctgggacacccgcatcaccgaggacgacctccacaacgaggagaagatcacccagcagatggaccccgagcaccggcagctggccaacgccatcttcaagctgacgtaccagaacaaggtggtgaaggtccagcgccccaccccgaaggggaccgtgatggacatcatcagccggaaggaccagcgcggctccggccaggtggggacctacggcctcaacaccttcacgaacatggaggcccagctggtccggcagatggagggggagggcgtgctgagcaaggccgacctcgagaacccccacctcctggagaagaagatcacccagtggctcgagaccaagggggtggagcgcctgaagcggatggcgatctccggcgacgactgcgtcgtgaagcccatcgacgaccgcttcgccaacgccctgctcgccctgaacgacatgggcaaggtgcggaaggacatcccccagtggcagccgagcaaggggtggcacgactggcagcaggtccccttctgctcccaccacttccacgagctgatcatgaaggacggccgcaagctcgtggtgccctgccgcccccaggacgagctgatcgggcgggcccgcatcagccagggcgcggggtggtccctgaaggagaccgcctgcctcggcaaggcctacgcccagatgtggaacctgatgtacttccaccggcgcgacctgcggctcgccagcaacgcgatctgctccgccgtcccggtgcactggatccccacgagccgcaccacctggagcatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcgggtccctcatcggcctgaccagccgggccacctgggcgcagaacatcctgaccgccatccagcaggtccgctccctcatcggggacgaggagttcctggactacatgcccagcatgaagcggttccgcaaggaggaggagtccgagggcgccatctggtga

SEQ ID NO: 9975 - RNA, 9873 nt, synthetic construct
  misc_feature 1..9873: note = derived and/or modified CDS sequence (opt1) from DENV-3__FJ639730__SS-prME
  source 1..9873: mol_type = other RNA
accagcctgtgcctcatgatgatgctgcccgcgaccctggccttccacctcaccagccgggacggcgagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgccatcaactggaagggcaaggagctgaagtgcggctccgggatcttcgtgaccaacgaggtccacacgtggaccgagcagtacaagttccaggcggacagccccaagcgcctggccaccgccatcgccggcgcctgggagaacggggtgtgcggcatccgctccaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggccaagatcgtcaccgccgagacccagaactccagcttcatcatcgacggccccaacacccccgagtgcccctccgccagccgggcgtggaacgtgtgggaggtggaggactacgggttcggcgtcttcacgaccaacatctggctgaagctccgcgaggtgtacacccagagctgcgaccaccggctgatgtccgccgccatcaaggacgagaaggccgtgcacgccgacatgggctactggatcgagagccagaagaacgggtcctggaagctggagaaggcgagcttcatcgaggtcaagacctgcacctggccgaagtcccacacgctctggagcaacggcgtgctggagtccgacatgatcatccccaagagcctggccgggcccatctcccagcacaaccaccgcccgggctaccacacccagaccgccgggccctggcacctcggcaagctggagctggacttcaactactgcgagggcaccacggtggtcatcaccgagaactgcgggacccggggccccagcctccgcaccacgaccgtgtccgggaagctgatccacgagtggtgctgccggagctgcaccctgcccccgctccgctacatgggcgaggacgggtgctggtacggcatggagatccggcccatcaacgagaaggaggagaacatggtgaagtccctggtcagcgccggctccgggaaggtggacaacttcaccatgggcgtgctgtgcctcgccatcctgttcgaggaggtcatgcgcgggaagttcggcaagaagcacatgatcgcgggggtgctgttcacgttcgtgctcctgctgagcggccagatcacctggcgggacatggcccacaccctcatcatgatcggctccaacgccagcgaccgcatggggatgggcgtcacctacctggccctgatcgccacgttcaagatccagcccttcctcgcgctggggttcttcctgcggaagctcaccagccgcgagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgtccctgacgtgcagcaacaccatcttcaccctgaccgtcgcctggcggacggccaccctcatcctggccggggtgtccctgctcccgctgtgccagagctccagcatgcgcaagaccgactggctgcccatgaccgtcgcggccatgggcgtgccgcccctgccgctgttcatcttctccctgaaggacacgcccaagcggcgcagctggcccctcaacgagggggtgatggccgtcggcctggtgtccatcctggccagctccctcctgcgcaacgacgtgcccatggccggcccgctggtcgccggcgggctcctgatcgcctgctacgtgatcaccgggaccagcgccgacctgaccgtggagaaggccgccgacgtcacgtgggaggaggaggcggagcagaccggggtgtcccacaacctcatgatcaccgtggacgacgacgggaccatgcggatcaaggacgacgagaccgagaacatcctgacggtcctgctcaagaccgccctgctgatcgtgagcggcatcttcccctactccatccccgccaccctcctggtgtggcacacctggcagaagcagacgcagcgcagcggcgtcctgtgggacgtgccctccccgcccgagacccagaaggccgagctcgaggagggggtgtaccggatcaagcagcagggcatcttcgggaagacccaggtcggcgtgggggtgcagaaggagggcgtcttccacaccatgtggcacgtgacgcgcggcgccgtgctgacccacaacgggaagcggctggagcccaactgggcgagcgtcaagaaggacctcatctcctacggcgggggctggcgcctgaacgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaacaaggagggcaaggtggtggggctgtacggcaacggggtcgtgaccaagaacggcgggtacgtgtccggcatcgcccagacgaacgccgagcccgacggccccacccccgagctcgaggaggagatgttcaagaagcggaacctgaccatcatggacctgcacccggggagcggcaagacccgcaagtacctccccgccatcgtccgggaggccatcaagcgccggctgcgcacgctgatcctcgcgcccacccgggtggtggccgccgagatggaggaggccctgaaggggctgcccatccgctaccagaccaccgccacgaagtccgagcacaccggccgggagatcgtcgacctcatgtgccacgcgaccttcaccatgcgcctgctgagcccggtgcgggtgcccaactacaacctcgtcatcatggacgaggcccacttcacggaccccgcctccatcgccgcccgcgggtacatcagcacccgggtgggcatgggcgaggcggccgccatcttcatgaccgccacgccgcccgggacggcggaggccttcccccagtccaacgcccccatccaggacgaggagcgcgacatccccgagcggagctggaactccggcaacgagtggatcaccgacttcgtggggaagaccgtctggttcgtgcccagcatcaaggccggcaacgacatcgccaactgcctgcgcaagaacgggaagaaggtgatccagctgtcccgcaagaccttcgacacggagtaccagaagacccggctcaacgactgggacttcgtcgtgaccaccgacatcagcgagatgggcgcgaacttcaaggccgaccgcgtgatcgacccccggcgctgcctgaagcccgtcatcctgacggacggccccgagcgggtgatcctcgccgggccgatgcccgtgaccgccgcctccgcggcccagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtggagctcatgcggcgcggggacctgcccgtctggctggcccacaaggtggccagcgagggcatcaagtacaccgaccggaagtggtgcttcgacggggagcgcaacaaccagatcctcgaggagaacatggacgtggagatctggaccaaggagggcgagcggaagaagctgcgcccgcggtggctggacgcgcgcacctactccgaccccctcgccctgaaggagttcaaggacttcgccgccggccgcaagagcatcgccctggacctcgtcacggagatcgggcgggtgccctcccacctggcgcaccgcacccggaacgccctggacaacctcgtgatgctgcacaccagcgagcacggcgggcgcgcctaccggcacgccgtcgaggagctgccggagaccatggagacgctcctgctgctcggcctgatgatcctgctcaccgggggcgccatgctgttcctgatcagcggcaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcgggatcctgacgctggccgcgatcgtggccgccaacgagatgggcctcctggagaccaccaagcgggacctgggcatgtccaaggagcccggggtcgtgagccccacctcctacctcgacgtggacctgcaccccgccagcgcctggacgctgtacgcggtcgccaccaccgtgatcaccccgatgctccgccacacgatcgagaactccaccgccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacgcactacgccatcatcggcccgggcctgcaggccaaggccacccgggaggcccagaagcgcaccgcggccgggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcggaccagctgggccctgtgcgaggccctgaccctcgcgaccggccccatcacgaccctgtgggagggctccccggggaagttctggaacaccaccatcgccgtgagcatggccaacatcttccgcggctcctacctggccggggcgggcctcgccttcagcatcatgaagtccgtcgggacgggccggcgcggcaccgggagccagggcgagaccctgggggagaagtggaagaagaagctgaaccagctcagccggaaggagttcgagctgtacaagaagtccggcatcaccgaggtggaccgcaccgaggccaaggaggggctgaagcggggcgagacgacccaccacgccgtgagccgcggctccgccaagctccagtggttcgtcgagcggaacatggtgatccccgaggggcgcgtgatcgacctgggctgcgggcggggcgggtggagctactactgcgcgggcctgaagaaggtcaccgaggtgcgcggctacaccaagggcgggcccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccgcaccatccgggtcctcaagatggtggagccctggctgcgcaacaaccagttctgcatcaaggtgctgaacccctacatgcccacggtcatcgagcacctcgagaagctgcagcggaagtacggcgggatgctggtgcgcaacccgctctcccggaacagcacccacgagatgtactggatctccaacggcaccgggaacatcgtgagctccgtcaacatggtgagccgcctgctgctcaaccggttcaccatgacgcaccgccggcccaccatcgagaaggacgtcgacctgggcgccggcacccgccacgtgaacgccgagcccgagaccccgaacatggacgtgatcggggagcggatcaagcgcatcaaggaggagcactccagcacgtggcactacgacgacgagaacccctacaagacctgggcctaccacggctcctacgaggtcaaggccaccgggagcgcgagctccatgatcaacggcgtggtgaagctgctcaccaagccctgggacgtcgtgcccatggtgacgcagatggccatgaccgacaccaccccgttcgggcagcagcgggtcttcaaggagaaggtggacacgcgcacgccccggcccatgcccggcacccgcaaggtgatggagatcaccgccgagtggctgtggcggacgctgggccgcaacaagaagccgcggctctgcacccgcgaggagttcaccaagaaggtccgcaccaacgccgccatgggggcggtgttcacggaggagaaccagtgggacagcgcccgggccgccgtggaggacgaggagttctggaagctggtcgaccgcgagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgcggacgacaccgccggctgggacacccggatcaccgaggacgacctccacaacgaggagaagatcacgcagcagatggaccccgagcaccgccagctggccaacgccatcttcaagctgacctaccagaacaaggtcgtgaaggtgcagcggcccaccccgaaggggaccgtcatggacatcatctcccgcaaggaccagcggggcagcggccaggtggggacctacggcctcaacacgttcaccaacatggaggcccagctggtgcgccagatggagggggagggcgtcctgtccaaggcggacctcgagaacccccacctcctggagaagaagatcacccagtggctcgagaccaagggggtggagcggctgaagcgcatggccatcagcggcgacgactgcgtggtcaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtcgtgccctgccgcccccaggacgagctgatcgggcgggcgcgcatctcccagggcgccgggtggagcctgaaggagacggcctgcctcggcaaggcctacgcccagatgtggtccctgatgtacttccaccgccgggacctgcgcctcgcgagcaacgccatctgctccgccgtgccggtccactggatccccaccagccggaccacctggagcatccacgcccaccaccagtggatgacgaccgaggacatgctgaccgtgtggaaccgcgtgtggatcgaggacaacccctggatggaggacaagacccccgtcacgacctgggaggacgtgccgtacctgggcaagcgggaggaccagtggtgcgggtccctcatcggcctgaccagccgcgcgacctgggcccagaacatcctgacggccatccagcaggtccggtccctcatcggggacgaggagttcctggactacatgcccagcatgaagcgcttccggaaggaggaggagtccgagggcgccatctggtga

SEQ ID NO: 9976 - RNA, 9873 nt, synthetic construct
  misc_feature 1..9873: note = derived and/or modified CDS sequence (opt1) from DENV-3__KF955464__SS-prME
  source 1..9873: mol_type = other RNA
accagcctgtgcctcatgatgatgctgcccgcgaccctggccttccacctcaccagccgggacggcgagccccggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgatcctgcggaagctgtgcatcgagggcaagatcacgaacatcaccaccgactcccgctgccccacccagggcgaggccacgctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggcctccaccgtggaggccgtgctgcccgagtacggcaccctcgggctggagtgcagcccgcgcaccggcctggacttcaacgagatgatcctcctgaccatgaagaacaaggcgtggatggtccaccggcagtggttcttcgacctgcccctcccctggacgtccggcgccaccaccgagacccccacgtggaaccgcaaggagctgctggtgaccttcaagaacgcccacgccaagaagcaggaggtggtcgtgctcgggagccaggagggcgccatgcacaccgcgctgaccggggccacggagatccagaactccggcgggaccaacatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccatcaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacctggatcggcctgaacagcaagaacacgtccatgagcttctcctgcatcgtgatcgggatcatcaccctgtacctcggcgccgtggtccaggccgacatggggtgcgtgatcaactggaagggcaaggagctgaagtgcggcaacgggatcttcgtgaccaacgaggtccacacctggacggagcagtacaagttccaggccgacagccccaagcgcctggcgaccgccatcgccggcgcctgggagaacggggtgtgcggcatccgctccaccacccggatggagaacctcctgtggaagcagatcgccaacgagctgaactacatcctctgggagaacaacatcaagctgacggtggtcgtgggggacatcatcggcgtgctggagcagggcaagcgcaccctcacgccccagccgatggagctgaagtacagctggaagacctgggggaaggcgaagatcgtcacggccgagacccagaactccagcttcatcatcgacggccccaacacccccgagtgcccctccgccagccgggcctggaacgtgtgggaggtggaggactacgggttcggcgtcttcaccacgaacatctggctgaagctccgcgaggtgtacacccagtcctgcgaccaccggctgatgagcgcggccatcaaggacgagcgcgccgtgcacgccgacatgggctactggatcgagagccagaagaacgggtcctggaagctggagaaggccagcttcatcgaggtcaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtggtcatcgccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatcaacgagaaggaggagaacatggtgaagtccctggtcagcgccggctccgggaaggtggacaacttcaccatgggcgtgctgtgcctcgccatcctgttcgaggaggtcatgcgggggaagttcggcaagaagcacatgatcgcgggggtgctgttcaccttcgtgctcctgctgagcggccagatcacctggcgcgacatggcccacacgctcatcatgatcggctccaacgccagcgaccggatggggatgggcgtcacctacctggccctgatcgccaccttcaagatccagcccttcctcgcgctggggttcttcctgcgcaagctcacctcccgggagaacctgctgctcggcgtgggcctggccatggccacgaccctgcagctccccgaggacatcgagcagatggccaacgggatcgcgctgggcctgatgaccctcaagctgatcacccagttcgagacgtaccagctgtggaccgccctcgtgagcctgacctgcagcaacaccatcttcacgctgaccgtcgcctggcgcaccgccaccctcatcctggccggggtgtccctgctcccgctgtgccagagctccagcatgcggaagacggactggctgcccatgaccgtcgcggccatgggcgtgccgcccctgccgctgttcatcttctccctgaaggacacccccaagcgcaagagctggcccctcaacgagggggtgatggccgtcggcctggtgtccatcctggccagctccctcctgcgcaacgacgtgcccatggccggcccgctggtcgccggcgggctcctgatcgcctgctacgtgatcaccgggacgagcgccgacctgaccgtggagaaggccgccgacgtcacctgggaggaggaggcggagcagaccggggtgtcccacaacctcatgatcacggtggacgacgacgggaccatgcggatcaaggacgacgagaccgagaacatcctgaccgtcctgctcaagaccgccctgctgatcgtgagcggcatcttcccctactccatccccgccacgctcctggtgtggcacacctggcagaagcagacccagcgcagcggcgtcctgtgggacgtgccctccccgcccgagacccagaaggccgagctcgaggagggggtgtaccggatcaagcagcagggcatcttcgggaagacgcaggtcggcgtgggggtgcagaaggagggcgtcttccacaccatgtggcacgtgacccgcggcgccgtgctgacccacaacgggaagcggctggagcccaactgggcgagcgtcaagaaggacctcatctcctacggcgggggctggcgcctgagcgcccagtggcagaagggggaggaggtccaggtgatcgccgtcgagcccggcaagaacccgaagaacttccagacgatgcccggcatcttccagaccaccaccggggagatcggcgccatcgcgctggacttcaagcccgggacgtccggcagcccgatcatcaaccgggagggcaaggtggtggggctgtacggcaacggggtcgtgaccaagaacggcgggtacgtgagcggcatcgcccagaccaacgccgagcccgacggccccacccccgagctcgaggaggagatgttcaagaagcgcaacctgacgatcatggacctgcacccggggtccggcaagacccggaagtacctccccgccatcgtccgcgaggccatcaagcggcgcctgcggaccctgatcctcgcgcccacccgcgtggtggccgccgagatggaggaggccctgaaggggctgcccatccggtaccagacgaccgccaccaagagcgagcacaccggccgcgagatcgtcgacctcatgtgccacgcgacgttcaccatgcggctgctgtccccggtgcgcgtgcccaactacaacctcatcatcatggacgaggcccacttcaccgaccccgccagcatcgccgcccgggggtacatctccacccgcgtcggcatgggcgaggcggccgccatcttcatgacggccacgccgcccgggaccgcggaggccttcccccagagcaacgcccccatccaggacgaggagcgggacatccccgagcgctcctggaacagcggcaacgagtggatcaccgacttcgtggggaagacggtgtggttcgtcccctccatcaaggccggcaacgacatcgccaactgcctgcgcaagaacgggaagaaggtgatccagctgagccggaagaccttcgacaccgagtaccagaagacccgcctcaacgactgggacttcgtggtcacgaccgacatctccgagatgggcgcgaacttcaaggccgaccgggtgatcgacccccgccggtgcctgaagcccgtgatcctgaccgacggccccgagcgcgtcatcctcgccgggccgatgcccgtgaccgccgccagcgcggcccagcggcgcggccgggtggggcgcaacccccagaaggagaacgaccagtacatcttcacgggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagagccggaagaccttcgtcgagctcatgcgccgcggggacctgcccgtgtggctggcccacaaggtcgcctccgagggcatcaagtacaccgaccgcaagtggtgcttcgacggggagcggaacaaccagatcctcgaggagaacatggacgtggagatctggacgaaggagggcgagcgcaagaagctgcggccgcgctggctggacgcgcgcacctacagcgaccccctcgccctgaaggagttcaaggacttcgccgccggccggaagtccatcgccctggacctcgtgaccgagatcgggcgcgtccccagccacctggcgcaccggacccgcaacgccctggacaacctcgtgatgctgcacacgtccgagcacggcgggcgggcctaccgccacgccgtggaggagctgccggagaccatggagaccctcctgctgctcggcctgatgatcctgctcaccgggggcgccatgctgttcctgatcagcggcaaggggatcggcaagacgagcatcgggctcatctgcgtcatcgtgtccagcggcatgctgtggatggcggacgtgcccctgcagtggatcgcctccgccatcgtcctcgagttcttcatgatggtgctgctgatccccgagcccgagaagcagcggaccccgcaggacaaccagctcgcctacgtggtcatcgggatcctgaccctggccgcgatcgtggccgccaacgagatgggcctcctggagaccacgaagcgcgacctgggcatgagcaaggagcccggggtggtctcccccaccagctacctcgacgtggacctgcaccccgcctccgcctggaccctgtacgcggtggccaccacggtcatcaccccgatgctccggcacaccatcgagaacagcaccgccaacgtgtccctggccgcgatcgccaaccaggccgtggtcctgatgggcctcgacaaggggtggcccatcagcaagatggacctgggcgtgcccctgctcgccctggggtgctactcccaggtgaaccccctgacgctcaccgccgcggtcctgctgctcgtgacccactacgccatcatcggcccgggcctgcaggccaaggccacccgcgaggcccagaagcggacggcggccgggatcatgaagaaccccaccgtggacggcatcatgaccatcgacctggaccccgtcatctacgacagcaagttcgagaagcagctcggccaggtgatgctgctggtgctctgcgccgtccagctgctgctcatgcgcacctcctgggccctgtgcgaggccctgacgctcgcgaccggccccatcaccaccctgtgggagggcagcccggggaagttctggaacacgaccatcgccgtgtccatggccaacatcttccggggcagctacctggccggggcgggcctcgccttctccatcatgaagtccgtggggaccggccgccggggcaccgggtcccagggcgagacgctgggggagaagtggaagaagaagctgaaccagctcagccgcaaggagttcgacctgtacaagaagtccggcatcaccgaggtcgaccggaccgaggccaaggaggggctgaagcgcggcgagaccacccaccacgccgtgtcccggggcagcgccaagctccagtggttcgtggagcgcaacatggtcatccccgaggggcgggtgatcgacctgggctgcgggcgcggcgggtggtcctactactgcgcgggcctgaagaaggtgacggaggtccgcggctacaccaagggcgggcccgggcacgaggagcccgtgccgatgagcacctacggctggaacatcgtgaagctcatgtccgggaaggacgtcttctacctgccgcccgagaagtgcgacaccctgctgtgcgacatcggcgagagctcccccagcccgacggtggaggagtcccggaccatccgcgtgctccggatggtcgagccctggctgcgcaacaaccagttctgcatcaaggtgctgaacccctacatgcccaacgtgatcgagcacctcgagcggctgcagcgcaagtacggcgggatgctggtccggaacccgctcagccgcaactccacccacgagatgtactggatcagcaacggcaccgggaacatcgtgtccagcgtgaacatggtctcccggctgctgctcaaccgcttcacgatgacccaccggcgccccaccatcgagaaggacgtggacctgggcgccggcacccggcacgtcaacgccgagcccgagacgccgaacatggacgtgatcggggagcgcatcaagcggatcaaggaggagcacagctccacctggcactacgacgacgagaacccctacaagacctgggcctaccacggcagctacgaggtgaaggccaccgggtccgcgagcagcatgatcaacggcgtcgtgaagctgctcacgaagccctgggacgtggtccccatggtgacccagatggccatgaccgacaccacgccgttcgggcagcagcgcgtgttcaaggagaaggtcgacacccggacgccccggcccatgcccggcacccggaaggtgatggagatcacggccgagtggctgtggcgcaccctgggccgcaacaagaagccgcggctctgcacccgcgaggagttcaccaagaaggtgcggacgaacgccgccatgggggcggtcttcaccgaggagaaccagtgggactccgcccgcgccgccgtggaggacgaggagttctggaagctggtggacaaggagcgggagctgcacaagctcggcaagtgcgggagctgcgtctacaacatgatgggcaagcgcgagaagaagctgggggagttcggcaaggcgaagggctcccgggccatctggtacatgtggctgggggcccgctacctcgagttcgaggccctgggcttcctgaacgaggaccactggttcagccgggagaactcctacagcggggtggagggcgaggggctccacaagctgggctacatcctgcgcgacatctccaagatccccggcggggccatgtacgcggacgacaccgccggctgggacacccggatcacggaggacgacctccacaacgaggagaagatcacccagcagatggaccccgagcaccgccagctggccaacgccatcttcaagctgacctaccagaacaaggtggtcaaggtgcagcggcccaccccgaaggggacggtgatggacatcatcagccgcaaggaccagcggggctccggccaggtcgggacctacggcctcaacaccttcaccaacatggaggcccagctggtgcgccagatggagggggagggcgtgctgagcgaggcggacctcgagaacccccacctcctggagaagaagatcacccagtggctcgagacgaagggggtcgagcggctgaagcgcatggccatctccggcgacgactgcgtggtgaagcccatcgacgaccggttcgccaacgccctgctcgccctgaacgacatgggcaaggtccgcaaggacatcccccagtggcagccgagcaaggggtggcacgactggcagcaggtccccttctgctcccaccacttccacgagctgatcatgaaggacggccggaagctcgtggtcccctgccgcccccaggacgagctgatcgggcgcgcgcggatcagccagggcgccgggtggtccctgaaggagaccgcctgcctcggcaaggcctacgcccagatgtggagcctgatgtacttccaccgccgggacctgcgcctcgcgtccaacgccatctgcagcgccgtgccggcccactggatccccacctcccggaccacgtggagcatccacgcgcaccaccagtggatgaccaccgaggacatgctgaccgtgtggaaccgcgtctggatcgaggacaacccctggatggaggacaagacgcccgtgaccacctgggaggacgtgccgtacctgggcaagcgggaggaccagtggtgcgggagcctcatcggcctgacctcccgcgccacgtgggcccagaacatcctgaccgccatccagcaggtccggagcctcatcggggacgaggagttcctggactacatgccctccatgaagcgcttccggaaggaggaggagagcgagggcgccatctggtga

SEQ ID NO: 9977 - RNA, 9873 nt, synthetic construct
  misc_feature 1..9873: note = derived and/or modified CDS sequence (opt1) from DENV-3__FJ639731__SS-prME
  source 1..9873: mol_type = other RNA
accagcctgtgcctcatgatgatgctgcccgcgaccctggccttccacctcaccagccgggacggcgagccccggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgggacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccgtgctgatcaaggtggagtacaagggcgaggacgccccgtgcaagatccccttcagcaccgaggacgggcagggcaaggcgcacaacggccgcctgatcaccgccaaccccgtcgtgacgaagaaggaggagcccgtgaacatcgaggccgagccgcccttcggggagtccaacatcgtcatcggcatcggggacaaggccctcaagatcaactggtacaagaagggcagctccatcgggaagatgttcgaggcgaccgcccggggcgcccgccggatggccatcctgggcgacaccgcctgggacttcgggagcgtgggcggggtgctgaactccctcggcaagatggtccaccagatcttcgggagcgcgtacaccgccctgttctccggcgtgagctggatcatgaagatcggcatcggggtgctgctcacgtggatcggcctgaactccaagaacaccagcatgtccttcagctgcatcgtcatcgggatcatcaccctgtacctcggcgccgtggtgcaggccgacatggggtgcgccatcaactggaagggcaaggagctgaagtgcggctccgggatcttcgtcaccaacgaggtgcacacgtggaccgagcagtacaagttccaggcggacagccccaagcgcctggccaccgccatcgccggcgcctgggagaacggggtgtgcggcatccgctccaccacgcggatggagaacctcctgtggaagcagatcgcgaacgagctgaactacatcctctgggagaacaacatcaagctgaccgtcgtggtgggggacatcatcggcgtcctggagcagggcaagcgcaccctcacgccccagccgatggagctgaagtacagctggaagacgtgggggaaggccaagatcgtgaccgccgagacccagaactccagcttcatcatcgacggccccaacacccccgagtgcccctccgccagccgggcgtggaacgtgtgggaggtcgaggactacgggttcggcgtgttcacgaccaacatctggctgaagctccgcgaggtgtacacccagagctgcgaccaccggctgatgtccgccgccatcaaggacgagcgcgccgtccacgccgacatgggctactggatcgagagccagaagaacgggtcctggaagctggagaaggcgagcttcatcgaggtgaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaagatggacaacttcaccatgggcgtgctgtgcctcgccatcctgttcgaggaggtcatgcgggggaagttcggcaagaagcacatgatcgcgggggtgctgttcacgttcgtgctcctgctgagcggccagatcacctggcgcgacatggcccacaccctcatcatgatcggctccaacgccagcgaccggatggggatgggcgtcacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgtccctgacgtgcagcaacaccatcttcaccctgaccgtcgcctggcgcacggccaccctcatcctggccggggtgtccctgctcccgctgtgccagagctccagcatgcggaagaccgactggctgcccatgaccgtcgcggccatgggcgtgccgcccctgccgctgttcatcttctccctgaaggacacgcccaagcgccgcagctggcccctcaacgagggggtgatggccgtcggcctggtgtccatcctggccagctccctcctgcggaacgacgtgcccatggccggcccgctggtcgccggcgggctcctgatcgcctgctacgtgatcaccgggaccagcgccgacctgaccgtggagaaggccgccgacgtcacgtgggaggaggaggcggagcagaccggggtgtcccacaacctcatgatcaccgtggacgacgacgggaccatgcgcatcaaggacgacgagaccgagaacatcctgacggtcctgctcaagaccgccctgctgatcgtgagcggcatcttcccctactccatccccgccaccctcctggtgtggcacacctggcagaagcagacgcagcggagcggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagcccaactgggcgagcgtcaagaaggacctcatctcctacggcgggggctggcggctgaacgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaacaaggagggcaaggtggtggggctgtacggcaacggggtcgtgaccaagaacggcgggtacgtgtccggcatcgcccagacgaacgccgagcccgacggccccacccccgagctcgaggaggagatgttcaagaagcgcaacctgaccatcatggacctgcacccggggagcggcaagacccggaagtacctccccgccatcgtccgcgaggccatcaagcggcgcctgcggacgctgatcctcgcgcccacccgcgtggtggccgccgagatggaggaggccctgaaggggctgcccatccggtaccagaccaccgccacgaagtccgagcacaccggccgcgagatcgtcgacctcatgtgccacgcgaccttcaccatgcggctgctgagcccggtgcgcgtgcccaactacaacctcgtcatcatggacgaggcccacttcacggaccccgcctccatcgccgcccgggggtacatcagcacccgcgtgggcatgggcgaggcggccgccatcttcatgaccgccacgccgcccgggacggcggaggccttcccccagtccaacgcccccatccaggacgaggagcgggacatccccgagcgcagctggaactccggcaacgagtggatcaccgacttcgtggggaagaccgtctggttcgtgcccagcatcaaggccggcaacgacatcgccaactgcctgcgcaagaacgggaagaaggtgatccagctgtcccggaagaccttcgacacggagtaccagaagacccgcctcaacgactgggacttcgtcgtgaccaccgacatcagcgagatgggcgcgaacttcaaggccgaccgggtgatcgacccccgccggtgcctgaagcccgtcatcctgacggacggccccgagcgcgtgatcctcgccgggccgatgcccgtgaccgccgcctccgcggcccagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagacgttcgtggagctcatgcgccgcggggacctgcccgtctggctggcccacaaggtggccagcgagggcatcaagtacaccgaccgcaagtggtgcttcgacggggagcggaacaaccagatcctcgaggagaacatggacgtggagatctggaccaaggagggcgagcgcaagaagctgcggccgcgctggctggacgcgcgcacctactccgaccccctcgccctgaaggagttcaaggacttcgccgccggccgcaagagcatcgccctggacctcgtcacggagatcgggcgcgtgccctcccacctggcgcaccggacccgcaacgccctggacaacctcgtgatgctgcacaccagcgagcacggcgggcgggcctaccgccacgccgtcgaggagctgccggagaccatggagacgctcctgctgctcggcctgatgatcctgctcaccgggggcgccatgctgttcctgatcagcggcaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcggaccccgcaggacaaccagctcgcctacgtcgtgatcgggatcctgacgctggccgcgatcgtggccgccaacgagatgggcctcctggagaccaccaagcgcgacctgggcatgtccaaggagcccggggtcgtgagccccacctcctacctcgacgtggacctgcaccccgccagcgcctggacgctgtacgcggtcgccaccaccgtgatcaccccgatgctccggcacacgatcgagaactccaccgccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacgcactacgccatcatcggcccgggcctgcaggccaaggccacccgcgaggcccagaagcggaccgcggccgggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcgcaccagctgggccctgtgcgaggccctgaccctcgcgaccggccccatcacgaccctgtgggagggctccccggggaagttctggaacaccaccatcgccgtgagcatggccaacatcttccggggctcctacctggccggggcgggcctcgccttcagcatcatgaagtccgtcgggacgggccgccggggcaccgggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagacgacccaccacgccgtgagccggggctccgccaagctccagtggttcgtcgagcgcaacatggtgatccccgaggggcgggtgatcgacctgggctgcgggcgcggcgggtggagctactactgcgcgggcctgaagaaggtcaccgaggtgcgcggctacaccaagggcgggcccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccggaccatccgcgtcctcaagatggtggagccctggctgcggaacaaccagttctgcatcaaggtgctgaacccctacatgcccacggtcatcgagcacctcgagcgcctgcagcggaagtacggcgggatgctggtgcgcaacccgctctcccggaacagcacccacgagatgtactggatctccaacggcaccgggaacatcgtgagctccgtcaacatggtgagccgcctgctgctcaaccggttcaccatgacgcaccgccggcccaccatcgagaaggacgtcgacctgggcgccggcacccgccacgtgaacgccgagcccgagaccccgaacatggacgtgatcggggagcggatcaagcgcatcaaggaggagcactccagcacgtggcactacgacgacgagaacccctacaagacctgggcctaccacggctcctacgaggtcaaggccaccgggagcgcgagctccatgatcaacggcgtggtgaagctgctcaccaagccctgggacgtcgtgcccatggtgacgcagatggccatgaccgacaccaccccgttcgggcagcagcgggtcttcaaggagaaggtggacacgcgcacgccccggcccatgcccggcacccgcaaggtgatggagatcaccgccgagtggctgtggcggacgctgggccgcaacaagaagccgcgcctctgcacccgggaggagttcaccaagaaggtccgcaccaacgccgccatgggggcggtgttcacggaggagaaccagtgggacagcgcccgggccgccgtggaggacgaggagttctggaagctggtcgaccgcgagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgcggacgacaccgccggctgggacacccggatcaccgaggacgacctccacaacgaggagaagatcacgcagcagatggaccccgagcaccgccagctggccaacgccatcttcaagctgacctaccagaacaaggtcgtgaaggtgcagcggcccaccccgaaggggaccgtcatggacatcatctcccgcaaggaccagcggggcagcggccaggtggggacctacggcctcaacacgttcaccaacatggaggcccagctggtgcgccagatggagggggagggcgtcctgtccaaggcggacctcgagaacccccacctcctggagaagaagatcacccagtggctcgagaccaagggggtggagcggctgaagcgcatggccatcagcggcgacgactgcgtggtcaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtcgtgccctgccgcccccaggacgagctgatcgggcgcgcgcggatctcccagggcgccgggtggagcctgaaggagacggcctgcctcggcaaggcctacgcccagatgtggtccctgatgtacttccaccgccgggacctgcgcctcgcgagcaacgccatctgctccgccgtgccggtccactggatccccaccagccggaccacctggagcatccacgcccaccaccagtggatgacgaccgaggacatgctgaccgtgtggaaccgcgtgtggatcgaggacaacccctggatggaggacaagacccccgtcacgacctgggaggacgtgccgtacctgggcaagcgggaggaccagtggtgcgggtccctcatcggcctgaccagccgcgcgacctgggcccagaacatcctgacggccatccagcaggtccggtccctcatcggggacgaggagttcctggactacatgcccagcatgaagcgcttccggaaggaggaggagtccgagggcgccatctggtga

SEQ ID NO: 9978 - RNA, 9873 nt, synthetic construct
  misc_feature 1..9873: note = derived and/or modified CDS sequence (opt1) from DENV-3__HM181933__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgggacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgccatcaactggaagggcaaggagctgaagtgcggctccgggatcttcgtgaccaacgaggtccacacgtggaccgagcagtacaagttccaggcggacagccccaagcgcctggccaccgccatcgccggcgcctgggagaacggggtgtgcggcatccgctccaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtacagctggaagacgtgggggaaggccaagatcgtcaccgccgagacccagaactccagcttcatcatcgacggccccaacacccccgagtgcccctccgccagccgggcgtggaacgtgtgggaggtggaggactacgggttcggcgtcttcacgaccaacatctggctgaagctccgcgaggtgtacacccagagctgcgaccaccggctgatgtccgccgccatcaaggacgagcgcgccgtgcacgccgacatgggctactggatcgagagccagaagaacgggtcctggaagctggagaaggcgagcttcatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgccggcccagcctccgcaccacgaccgtgtccggcaagctgatccacgagtggtgctgccggagctgcaccctgcccccgctccgctacatgggggaggacggctgctggtacgggatggagatccggcccatcaacgagaaggaggagaacatggtgaagtccctggtcagcgccggctccggcaaggtggacaacttcaccatgggggtgctgtgcctcgccatcctgttcgaggaggtcatgcgcggcaagttcgggaagaagcacatgatcgcgggcgtgctgttcacgttcgtgctcctgctgagcgggcagatcacctggcgggacatggcccacaccctcatcatgatcggctccaacgccagcgaccgcatgggcatgggggtcacctacctggccctgatcgccacgttcaagatccagcccttcctcgcgctgggcttcttcctgcggaagctcaccagccgcgagaacctgctgctcggggtgggcctggccatggccaccaccctgcagctccccgaggacatcgagcagatggccaacggcatcgcgctggggctgatgacgctcaagctgatcacccagttcgagacctaccagctgtggaccgccctcgtgtccctgacgtgcagcaacaccatcttcaccctgaccgtcgcctggcggacggccaccctcatcctggccggcgtgtccctgctcccgctgtgccagagctccagcatgcgcaagaccgactggctgcccatgaccgtcgcggccatgggggtgccgcccctgccgctgttcatcttctccctgaaggacacgcccaagcgccggagctggcccctcaacgagggcgtgatggccgtcgggctggtgtccatcctggccagctccctcctgcgcaacgacgtgcccatggccggcccgctggtcgcgggcgggctcctgatcgcctgctacgtgatcaccggcaccagcgccgacctgaccgtggagaaggccgccgacgtcacgtgggaggaggaggcggagcagaccggggtgtcccacaacctcatgatcaccgtggacgacgacggcaccatgcggatcaaggacgacgagaccgagaacatcctgacggtcctgctcaagaccgccctgctgatcgtgagcgggatcttcccctactccatccccgccaccctcctggtgtggcacacctggcagaagcagacgcagcgcagcggcgtcctgtgggacgtgccctccccgcccgagacccagaaggccgagctcgaggagggcgtgtaccggatcaagcagcaggggatcttcggcaagacccaggtcggggtgggcgtgcagaaggagggggtcttccacaccatgtggcacgtgacgcgcggcgccgtgctgacccacaacggcaagcggctggagcccaactgggcgagcgtcaagaaggacctcatctcctacgggggcgggtggcgcctgaacgcccagtggcagaagggcgaggaggtccaggtgatcgccgtcgagcccgggaagaacccgaagaacttccagaccatgcccggcatcttccagaccacgaccggcgagatcggggccatcgcgctggacttcaagcccggcaccagcgggagcccgatcatcaaccgggagggcaaggtggtgggcctgtacgggaacggcgtcgtgaccaagaacgggggctacgtgtccgggatcgcccagacgaacgccgagcccgacggccccacccccgagctcgaggaggagatgttcaagaagcgcaacctgaccatcatggacctgcacccgggcagcgggaagacccggaagtacctccccgccatcgtccgcgaggccatcaagcggcgcctgcggacgctgatcctcgcgcccacccgcgtggtggccgccgagatggaggaggccctgaagggcctgcccatccggtaccagaccaccgccacgaagtccgagcacaccgggcgcgagatcgtcgacctcatgtgccacgcgaccttcaccatgcggctgctgagcccggtgcgcgtgcccaactacaacctcgtcatcatggacgaggcccacttcacggaccccgcctccatcgccgcccggggctacatcagcacccgcgtggggatgggcgaggcggccgccatcttcatgaccgccacgccgcccggcacggcggaggccttcccccagtccaacgcccccatccaggacgaggagcgcgacatccccgagcggagctggaactccgggaacgagtggatcaccgacttcgtgggcaagaccgtctggttcgtgcccagcatcaaggccgggaacgacatcgccaactgcctgcgcaagaacggcaagaaggtgatccagctgtcccggaagaccttcgacacggagtaccagaagacccgcctcaacgactgggacttcgtcgtgaccaccgacatcagcgagatgggggcgaacttcaaggccgaccgggtgatcgacccccgccggtgcctgaagcccgtcatcctgacggacggccccgagcgcgtgatcctcgccggcccgatgcccgtgaccgccgcctccgcggcccagcggcgcgggcgggtcggccgcaacccccagaaggagaacgaccagtacatcttcaccgggcagcccctgaacaacgacgaggaccacgcccactggaccgaggccaagatgctgctcgacaacatcaacaccccggagggcatcatccccgccctgttcgagcccgagcgggagaagtccgcggccatcgacggggagtaccgcctgaagggcgagtcccggaagacgttcgtggagctcatgcgccggggcgacctgcccgtctggctggcccacaaggtggccagcgaggggatcaagtacaccgaccgcaagtggtgcttcgacggcgagcggaacaaccagatcctcgaggagaacatggacgtggagatctggaccaaggagggggagcgcaagaagctgcgcccgcggtggctggacgcgcgcacctactccgaccccctcgccctgaaggagttcaaggacttcgccgccggccgcaagagcatcgccctggacctcgtcacggagatcggccgcgtgccctcccacctggcgcaccggacccgcaacgccctggacaacctcgtgatgctgcacaccagcgagcacgggggccgggcctaccgccacgccgtcgaggagctgccggagaccatggagacgctcctgctgctcgggctgatgatcctgctcaccggcggggccatgctgttcctgatcagcggcaagggcatcgggaagacctccatcggcctcatctgcgtgatcgtgagctccgggatgctgtggatggcggacgtccccctgcagtggatcgccagcgccatcgtgctcgagttcttcatgatggtgctgctgatccccgagcccgagaagcagcggaccccgcaggacaaccagctcgcctacgtcgtgatcggcatcctgacgctggccgcgatcgtggccgccaacgagatggggctcctggagaccaccaagcgcgacctgggcatgtccaaggagcccggcgtcgtgagccccacctcctacctcgacgtggacctgcaccccgccagcgcctggacgctgtacgcggtcgccaccaccgtgatcaccccgatgctccggcacacgatcgagaactccaccgccaacgtgagcctggccgcgatcgccaaccaggccgtcgtgctgatggggctcgacaagggctggcccatctccaagatggacctgggggtgcccctgctcgccctgggctgctacagccaggtcaaccccctgaccctcaccgccgcggtgctgctgctcgtgacgcactacgccatcatcgggccgggcctgcaggccaaggccacccgcgaggcccagaagcggaccgcggccggcatcatgaagaaccccaccgtcgacgggatcatgacgatcgacctggaccccgtgatctacgactccaagttcgagaagcagctcggccaggtgatgctgctggtcctctgcgccgtgcagctgctgctcatgcgcaccagctgggccctgtgcgaggccctgaccctcgcgaccgggcccatcacgaccctgtgggagggctccccgggcaagttctggaacaccaccatcgccgtgagcatggccaacatcttccgggggtcctacctggccggcgcggggctcgccttcagcatcatgaagtccgtcggcacggggcgccggggcaccggcagccagggggagaccctgggcgagaagtggaagaagaagctgaaccagctcagccgcaaggagttcgacctgtacaagaagtccgggatcaccgaggtggaccggaccgaggccaaggagggcctgaagcgcggggagacgacccaccacgccgtgagccggggctccgccaagctccagtggttcgtcgagcgcaacatggtgatccccgagggccgcgtgatcgacctggggtgcggccgcgggggctggagctactactgcgcggggctgaagaaggtcaccgaggtgcgcggctacaccaagggcgggcccggccacgaggagcccgtgccgatgtccacgtacgggtggaacatcgtcaagctcatgagcggcaaggacgtgttctacctgccgcccgagaagtgcgacaccctgctgtgcgacatcggggagtccagcccctccccgaccgtggaggagagccggaccatccgcgtcctcaagatggtggagccctggctgcggaacaaccagttctgcatcaaggtgctgaacccctacatgcccacggtcatcgagcacctcgagcgcctgcagcggaagtacggcggcatgctggtgcgcaacccgctctcccggaacagcacccacgagatgtactggatctccaacgggaccggcaacatcgtgagctccgtcaacatggtgagccgcctgctgctcaaccggttcaccatgacgcaccgccggcccaccatcgagaaggacgtcgacctgggggccggcacccgccacgtgaacgccgagcccgagaccccgaacatggacgtgatcggcgagcggatcaagcgcatcaaggaggagcactccagcacgtggcactacgacgacgagaacccctacaagacctgggcctaccacgggtcctacgaggtcaaggccaccggcagcgcgagctccatgatcaacggggtggtgaagctgctcaccaagccctgggacgtcgtgcccatggtgacgcagatggccatgaccgacaccaccccgttcggccagcagcgggtcttcaaggagaaggtggacacgcgcacgccccggcccatgcccgggacccgcaaggtgatggagatcaccgccgagtggctgtggcgcacgctgggccggaacaagaagccgcgcctctgcacccgggaggagttcaccaagaaggtccgcaccaacgccgccatgggcgcggtgttcacggaggagaaccagtgggacagcgcccgggccgccgtggaggacgaggagttctggaagctggtcgaccgcgagcgggagctgcacaagctcgggaagtgcggctcctgcgtgtacaacatgatggggaagcgcgagaagaagctgggcgagttcgggaaggcgaagggcagccgggccatctggtacatgtggctgggcgcccgctacctcgagttcgaggccctggggttcctgaacgaggaccactggttctcccgggagaacagctactccggcgtggagggggagggcctccacaagctggggtacatcctgcgcgacatcagcaagatccccggcggcgccatgtacgcggacgacaccgccgggtgggacacccggatcaccgaggacgacctccacaacgaggagaagatcacgcagcagatggaccccgagcaccgccagctggccaacgccatcttcaagctgacctaccagaacaaggtcgtgaaggtgcagcggcccaccccgaagggcaccgtcatggacatcatctcccgcaaggaccagcgggggagcggccaggtgggcacctacgggctcaacacgttcaccaacatggaggcccagctggtgcgccagatggagggcgagggggtcctgtccaaggcggacctcgagaacccccacctcctggagaagaagatcacccagtggctcgagaccaagggcgtggagcggctgaagcgcatggccatcagcggggacgactgcgtggtcaagcccatcgacgaccggttcgccaacgccctgctcgccctgaacgacatgggcaaggtgcgcaaggacatcccccagtggcagccgtccaagggctggcacgactggcagcaggtccccttctgcagccaccacttccacgagctgatcatgaaggacgggcgcaagctcgtcgtgccctgccggccccaggacgagctgatcggccgcgcgcggatctcccagggggccggctggagcctgaaggagacggcctgcctcgggaaggcctacgcccagatgtggtccctgatgtacttccaccgccgggacctgcgcctcgcgagcaacgccatctgctccgccgtgccggtccactggatccccaccagccggaccacctggagcatccacgcccaccaccagtggatgacgaccgaggacatgctgaccgtgtggaaccgcgtgtggatcgaggacaacccctggatggaggacaagacccccgtcacgacctgggaggacgtgccgtacctgggcaagcgggaggaccagtggtgcggctccctcatcgggctgaccagccgcgcgacctgggcccagaacatcctgacggccatccagcaggtccggtccctcatcggcgacgaggagttcctggactacatgcccagcatgaagcgcttccggaaggaggaggagtccgagggggccatctggtga

SEQ ID NO: 9979 - RNA, 9873 nt, synthetic construct
  misc_feature 1..9873: note = derived and/or modified CDS sequence (opt1) from DENV-3__JF295012__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaacaagaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccgcctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccggctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccgcggcgcccggcgcatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggctccgggatcttcgtcaccaacgaggtgcacacgtggaccgagcagtacaagttccaggccgacagccccaagcggctggcgaccgccatcgccggcgcctgggagaacggggtgtgcggcatccgctccaccacgcgcatggagaacctcctgtggaagcagatcgccaacgagctgaactacatcctctgggagaacaacatcaagctgaccgtcgtggtgggggacatcatcggcgtcctggagcagggcaagcggaccctcacgccccagccgatggagctgaagtacagctggaagacgtgggggaaggcgaagatcgtgaccgccgagacccagaactccagcttcatcatcgacggccccaacacccccgagtgcccctccgccagccgcgcctggaacgtgtgggaggtcgaggactacgggttcggcgtgttcacgaccaacatctggctgaagctccgggaggtgtacacccagagctgcgaccaccgcctgatgtccgcggccatcaaggacgagcgggccgtccacgccgacatgggctactggatcgagagccagaagaacgggtcctggaagctggagaaggccagcttcatcgaggtgaagacctgcacctggccgaagtcccacacgctctggagcaacggcgtgctggagtccgacatgatcatccccaagagcctggcggggcccatctcccagcacaaccaccgcccgggctaccacacccagaccgccgggccctggcacctcggcaagctggagctggacttcaactactgcgagggcaccacggtcgtgatcaccgagaactgcgggacccggggccccagcctccgcaccacgaccgtgtccgggaagctgatccacgagtggtgctgccggagctgcaccctgcccccgctccgctacatgggcgaggacgggtgctggtacggcatggagatccggcccatcaacgagaaggaggagaacatggtcaagtccctggtgagcgccggctccgggaaggtggacaacttcaccatgggcgtcctgtgcctcgccatcctgttcgaggaggtgatgcgcgggaagttcggcaagaagcacatgatcgccggggtgctgttcacgttcgtcctcctgctgagcggccagatcacctggcgggacatggcgcacaccctcatcatgatcggctccaacgccagcgaccgcatggggatgggcgtgacctacctggccctgatcgccacgttcaagatccagcccttcctcgccctggggttcttcctgcggaagctcaccagccgcgagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtctccctgacgtgcagcaacaccatcttcaccctgaccgtggcctggcggacggccaccctcatcctggccggggtctccctgctcccgctgtgccagagctccagcatgcgcaagaccgactggctgcccatgaccgtggccgcgatgggcgtgccgcccctgccgctgttcatcttctccctgaaggacacgcccaagcggcgcagctggcccctcaacgagggggtcatggccgtgggcctggtgtccatcctggccagctccctcctgcgcaacgacgtccccatggccggcccgctggtggccgggggcctcctgatcgcgtgctacgtgatcaccgggaccagcgccgacctgaccgtcgagaaggccgccgacgtgacgtgggaggaggaggccgagcagaccggcgtgtcccacaacctcatgatcaccgtcgacgacgacgggaccatgcggatcaaggacgacgagaccgagaacatcctgacggtgctgctcaagaccgcgctgctgatcgtgagcggcatcttcccctactccatccccgccaccctcctggtctggcacacctggcagaagcagacgcagcgcagcggcgtgctgtgggacgtgccctccccgcccgagacccagaaggccgagctcgaggagggggtctaccggatcaagcagcagggcatcttcgggaagacccaggtgggcgtgggggtccagaaggagggcgtgttccacaccatgtggcacgtgacgcgcggcgccgtcctgacccacaacgggaagcggctggagcccaactgggccagcgtgaagaaggacctcatctcctacggcgggggctggcgcctgagcgcgcagtggcagaagggggaggaggtgcaggtcatcgccgtggagcccggcaagaacccgaagaacttccagaccatgcccggcatcttccagaccacgaccggggagatcggcgccatcgccctggacttcaagcccgggaccagcggctccccgatcatcaaccgggagggcaaggtggtcgggctgtacggcaacggggtggtgaccaagaacggcgggtacgtcagcggcatcgcgcagacgaacgccgagcccgacggccccacccccgagctcgaggaggagatgttcaagaagcgcaacctgaccatcatggacctgcacccggggtccggcaagacccggaagtacctccccgccatcgtgcgcgaggccatcaagcggcgcctgcggacgctgatcctcgcccccacccgcgtggtcgcggccgagatggaggaggccctgaaggggctgcccatccggtaccagaccaccgccaccaagagcgagcacaccggccgcgagatcgtggacctcatgtgccacgccaccttcaccatgcggctgctgtccccggtgcgcgtccccaactacaacctcgtgatcatggacgaggcgcacttcacggaccccgccagcatcgccgcccgggggtacatctccacccgcgtgggcatgggcgaggccgcggccatcttcatgaccgccacgccgcccgggacggccgacgcgttcccccagagcaacgcccccatccaggacgaggagcgggacatccccgagcgctcctggaacagcggcaacgagtggatcaccgacttcgccgggaagaccgtctggttcgtgccctccatcaaggccggcaacgacatcgccaactgcctgcgcaagaacgggaagaaggtgatccagctgagccggaagaccttcgacacggagtaccagaagaccaagctcaacgactgggacttcgtcgtgaccaccgacatctccgagatgggcgcgaacttcaaggccgaccgcgtgatcgacccccggcgctgcctgaagcccgtcatcctgacggacggccccgagcgggtgatcctcgccgggccgatgcccgtgaccgccgccagcgcggcccagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagagccgcaagacgttcgtggagctcatgcggcgcggggacctgcccgtctggctggcccacaaggtggcctccgagggcatcaagtacaccgaccggaagtggtgcttcgacggggagcgcaacaaccagatcctcgaggagaacatggacgtggagatctggaccaaggagggcgagcggaagaagctgcgcccgcggtggctggacgcgcgcacctacagcgaccccctcgccctgaaggagttcaaggacttcgccgccggccgcaagtccatcgccctggacctcgtcacggagatcgggcgggtgcccagccacctggcgcaccgcacccggaacgccctggacaacctcgtgatgctgcacaccagcgagcacggcgggcgcgcctaccggcacgccgtcgaggagctgccggagaccatggagacgctcctgctgctcggcctgatgatcctgctcaccgggggcgccatgctgttcctgatctccggcaaggggatcggcaagaccagcatcgggctcatctgcgtgatcgtgtccagcggcatgctgtggatggcggacgtccccctgcagtggatcgcctccgccatcgtgctcgagttcttcatgatggtgctgctgatccccgagcccgagaagcagcgcaccccgcaggacaaccagctcgcctacgtcgtgatcgggatcctgacgctggccgcgatcgtggccgccaacgagatgggcctcctggagaccaccaagcgggacctgggcatgagcaaggagcccggggtcgtgtcccccaccagctacctcgacgtggacctgcaccccgcctccgcctggacgctgtacgcggtcgccaccaccgtgatcaccccgatgctccgccacacgatcgagaacagcaccgccaacgtgtccctggccgcgatcgccaaccaggccgtcgtgctgatgggcctcgacaaggggtggcccatcagcaagatggacctgggcgtgcccctgctcgccctggggtgctactcccaggtcaaccccctgaccctcaccgccgcggtgctgctgctcgtgacgcactacgccatcatcggcccgggcctgcaggccaaggccacccgggaggcccagaagcgcaccgcggccgggatcatgaagaaccccaccgtcgacggcatcatgacgatcgacctggaccccgtgatctacgacagcaagttcgagaagcagctcggccaggtgatgctgctggtcctctgcgccgtgcagctgctgctcatgcggacctcctgggccctgtgcgaggccctgaccctcgcgaccggccccatcacgaccctgtgggagggcagcccggggaagttctggaacaccaccatcgccgtgtccatggccaacatcttccgcggcagctacctggccggggcgggcctcgccttctccatcatgaagtccgtcgggacgggccggcgcggcaccgggagccagggcgagaccctgggggagaagtggaagaagaagctgaaccagctctcccggaaggagttcgacctgtacaagaagtccggcatcaccgaggtggaccgcaccgaggccaaggaggggctgaagcggggcgagacgacccaccacgccgtgtcccgcggcagcgccaagctccagtggttcgtcgagcggaacatggtgatccccgaggggcgcgtgatcgacctgggctgcgggcggggcgggtggtcctactactgcgcgggcctgaagaaggtcaccgaggtgcgcggctacaccaagggcgggcccgggcacgaggagcccgtgccgatgagcacgtacggctggaacatcgtcaagctcatgtccgggaaggacgtgttctacctgccgcccgagaagtgcgacaccctgctgtgcgacatcggcgagagctcccccagcccgaccgtggaggagtcccgcaccatccgggtcctcaagatggtggagccctggctgcgcaacaaccagttctgcatcaaggtgctgaacccctacatgcccacggtcatcgagcacctcgagcggctgcagcgcaagtacggcgggatgctggtgcggaacccgctcagccgcaactccacccacgagatgtactggatcagcaacggcaccgggaacatcgtgtccagcgtcaacatggtgtcccggctgctgctcaaccgcttcaccatgacgcaccggcgccccaccatcgagaaggacgtcgacctgggcgccggcacccggcacgtgaacgccgagcccgagaccccgaacatggacgtgatcggggagcgcatcaagcggatcaaggaggagcacagctccacgtggcactacgacgacgagaacccctacaagacctgggcctaccacggcagctacgaggtcaaggccaccgggagcgcgtccagcatgatcaacggcgtggtgaagctgctcaccaagccctgggacgtcgtgcccatggtgacgcagatggccatgaccgacaccaccccgttcgggcagcagcgcgtcttcaaggagaaggtggacacgcggacgccccggcccatgcccggcacccggaaggtgatggagatcaccgccgagtggctgtggcgcacgctgggccggaacaagaagccgcgcctctgcacccgcgaggagttcaccaagaaggtccggaccaacgccgccatgggggcggtgttcacggaggagaaccagtgggactccgcccgcgccgccgtggaggacgaggagttctggaagctggtcgaccgggagcgcgagctgcacaagctcggcaagtgcgggagctgcgtgtacaacatgatgggcaagcgggagaagaagctgggggagttcggcaaggcgaagggctcccgcgccatctggtacatgtggctgggggcccggtacctcgagttcgaggccctgggcttcctgaacgaggaccactggttcagccgcgagaactcctacagcggggtggagggcgaggggctccacaagctgggctacatcctgcgggacatctccaagatccccggcggggccatgtacgcggacgacaccgccggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccaccccgaaggggaccgtcatggacatcatcagccggaaggaccagcgcggctccggccaggtggggacctacggcctcaacacgttcaccaacatggaggcccagctggtgcggcagatggagggggagggcgtcctgagcaaggcggacctcgagaacccccacctcctggagaagaagatcacccagtggctcgagaccaagggggtggagcgcctgaagcggatggccatctccggcgacgactgcgtggtcaagcccatcgacgaccgcttcgccaacgccctgctcgccctgaacgacatgggcaaggtgcggaaggacatcccccagtggcagccgagcaaggggtggcacgactggcagcaggtccccttctgctcccaccacttccacgagctgatcatgaaggacggccgcaagctcgtcgtgccctgccggccccaggacgagctgatcgggcgcgcgcgcatcagccagggcgccgggtggtccctgaaggagacggcctgcctcggcaaggcctacgcccagatgtggagcctgatgtacttccaccggcgcgacctgcggctcgcgtccaacgccatctgcagcgccgtgccggtccactggatccccaccagccgcaccacctggtccatccacgcccaccaccagtggatgacgaccgaggacatgctgaccgtgtggaaccgggtgtggatcgaggacaacccctggatggaggacaagacccccgtcacgacctgggaggacgtgccgtacctgggcaagcgcgaggaccagtggtgcgggagcctcatcggcctgacctcccgggcgacctgggcccagaacatcctgacggccatccagcaggtccgcagcctcatcggggacgaggagttcctggactacatgccctccatgaagcggttccgcaaggaggaggagagcgagggcgccatctggtga

SEQ ID NO: 9980 - RNA, 9873 nt, synthetic construct
  misc_feature 1..9873: note = derived and/or modified CDS sequence (opt1) from DENV-3__FJ898463__SS-prME
  source 1..9873: mol_type = other RNA
accagcctctgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcacggagggcgcctggcgccaggtggagaaggtggagacctgggccctgcgccacccggggttcaccatcctcgccctgttcctggcgcactacatcggcacctccctcacgcagaaggtggtgatcttcatcctgctgatgctcgtgacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcggtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggccatcctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgccccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgccgacatgggctactggatcgagagccagaagaacgggtcctggaagctggagaaggcgagcctgatcgaggtcaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgttcttcaccttcgtgctgctcctgtccggccagatcacctggcgcgacatggcccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcggaagaccgactggctccccatggccgtcgccgccatgggcgtgccgcccctcccgctgttcatcttcagcctcaaggacacgctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacagccagaaggagaacgaccagtacatcttcaccggccagcccctcaacaacgacgaggaccacgcgcactggaccgaggccaagatgctgctggacaacatcaacacgcccgaggggatcatccccgccctcttcgagccggagcgggagaagtccgccgcgatcgacggcgagtaccgcctgaagggcgagagccggaagaccttcgtggagctgatgcgccgcggggacctccccgtctggctggcccacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtacagcgaccccctggccctcaaggagttcaaggacttcgcggccggccgcaagtccatcgccctggacctggtgaccgagatcgggcgggtgccgagccacctcgcccaccgcacccggaacgccctggacaacctggtcatgctccacaccagcgagcacggcgggcgcgcgtaccggcacgccgtggaggagctgcccgagacgatggagaccctgctcctgctgggcctcatgatcctgctgaccgggggcgccatgctgttcctgatctccggcaaggggatcggcaagaccagcatcgggctgatctgcgtgatcgcctccagcggcatgctctggatggccgagatccccctgcagtggatcgcgtccgccatcgtcctggagttcttcatgatggtgctcctgatcccggagcccgagaagcagcgcacgccccaggacaaccagctggcctacgtggtcatcgggatcctcaccctggccgccatcatcgcggccaacgagatgggcctgctcgagaccaccaagcgggacctgggcatgagcaaggagcccggggtggtgtccccgacgagctacctggacgtcgacctccaccccgcctccgcctggaccctgtacgcggtggccaccaccgtgatcacgcccatgctgcgccacaccatcgagaacagcaccgccaacgtctccctcgccgccatcgcgaaccaggccgtggtgctgatgggcctggacaaggggtggcccatcagcaagatggacctcggcgtcccgctgctggccctcgggtgctactcccaggtgaaccccctgaccctgacggccgccgtgctcctgctgatcacccactacgcgatcatcggccccggcctccaggccaaggccacccgggaggcccagaagcgcaccgccgcggggatcatgaagaaccccacggtcgacggcatcatgaccatcgacctggacccggtgatctacgacagcaagttcgagaagcagctgggccaggtgatgctcctggtcctgtgcgccgtgcagctcctgctgatgcggacctcctgggccctctgcgaggccctgaccctggcgacgggccccatcaccaccctctgggagggcagccccgggaagttctggaacaccacgatcgccgtgtccatggccaacatcttccgcggcagctacctggccggggccggcctggcgttctccatcatgaagtccgtcgggaccggcaagcggggcaccgggagccagggcgagaccctcggggagaagtggaagaagaagctgaaccagctgtcccgcaaggagttcgacctctacaagaagtccggcatcaccgaggtggaccggacggaggccaaggaggggctgaagcgcggcgagaccacccaccacgccgtgtcccggggcagcgccaagctgcagtggttcgtcgagcgcaacatggtgatccccgaggggcgggtgatcgacctcggctgcgggcgcggcgggtggtcctactactgcgccggcctgaagaaggtcaccgaggtgcggggctacacgaagggcgggccggggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccgcacgatccgcgtcctgaagatggtggagccctggctcaagaacaaccagttctgcatcaaggtgctgaacccctacatgcccaccgtcatcgagcacctggagcggctccagcgcaagcacggcgggatgctggtgcggaaccccctgagccgcaactccacccacgagatgtactggatcagcaacggcaccgggaacatcgtggcgtccgtcaacatggtgagccggctcctgctgaaccgcttcacgatgacccaccggcgccccaccatcgagaaggacgtggacctcggcgccggcacccggcacgtcaacgccgagccggagacgcccaacatggacgtgatcggggagcgcatcaagcggatcaaggaggagcacaactccacctggcactacgacgacgagaacccctacaagacctgggcctaccacggcagctacgaggtgaaggccaccgggtccgcgagcagcatgatcaacggcgtcgtgaagctgctgacgaagccgtgggacgtcgtgcccatggtgacccagatggccatgaccgacaccacgcccttcgggcagcagcgcgtcttcaaggagaaggtggacacccggacgccccggtccatgccgggcacccggcgcgtgatgggcatcacggccgagtggctctggaccaccctggggcggaacaagaagccccgcctgtgcacccgggaggagttcacgaagaaggtccgcaccaacgccgcgatgggcgccgtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacgcggatcaccgaggacgacctgcacaacgaggagaagatcacccagcagatggaccccgagcaccgccagctcgccaacgccatcttcaagctgacctaccagaacaaggtcgtgaaggtgcagcggccgacccccacgggcaccgtcatggacatcatctcccgcaaggaccagcggggcagcggccaggtgggcacctacgggctgaacaccttcacgaacatggaggcccagctcatccgccagatggagggcgagggggtgctgtccaaggcggacctggagaacccccacctccccgagaagaagatcacccagtggctggagaccaagggcgtcgagcggctgaagcgcatggccatcagcggcgacgactgcgtggtgaagccgatcgacgaccggttcgccaacgccctcctggccctgaacgacatggggaaggtccgcaaggacatcccccagtggcagccctccaagggctggcacgactggcagcaggtccccttctgcagccaccacttccacgagctcatcatgaaggacgggcggaagctggtggtcccgtgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtgcccgtgcactgggtccccacgagccgcaccacctggagcatccacgcccaccaccagtggatgaccacggaggacatgctgaccgtgtggaaccgggtgtggatcgaggacaacccgtggatggaggacaagacccccgtcaccacgtgggagaacgtgccctacctcgggaagcgcgaggaccagtggtgcggctccctgatcgggctgaccagccgggcgacctgggcccagaacatccccaccgccatccagcaggtccgctccctcatcggcaacgaggagttcctggactacatgccgagcatgaagcggttccgcaaggaggaggagtccgagggggccatctggtga

SEQ ID NO: 9981 - RNA, 9873 nt, synthetic construct
  misc_feature 1..9873: note = derived and/or modified CDS sequence (opt1) from DENV-3__GQ868616__SS-prME
  source 1..9873: mol_type = other RNA
accagcctctgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcacggagggcgcctggcgccaggtggagaaggtggagacctgggccctgcgccacccggggttcaccatcctcgccctgttcctggcgcactacatcggcacctccctcacgcagaaggtggtgatcttcatcctgctgatgctcgtgacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcggtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggccatcctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgccccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgccgacatgggctactggatcgagagccagaagaacgggtcctggaagctggagaaggcgagcctgatcgaggtcaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgttcttcaccttcgtgctgctcctgtccggccagatcacctggcgcgacatggcccacacgctgatcatgatcggcagcaacgcctccgaccggatggggatgggcgtcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtggcctggcgcaccgccaccctgatcctcgcgggggtcagcctgctgccggtgtgccagtccagctccatgcggaagaccgactggctccccatggccgtcgccgccatgggcgtgccgcccctcccgctgttcatcttcagcctcaaggacacgctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcgtgttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacagccagaaggagaacgaccagtacatcttcaccggccagcccctcaacaacgacgaggaccacgcgcactggaccgaggccaagatgctgctggacaacatcaacacgcccgaggggatcatccccgccctcttcgagccggagcgggagaagtccgccgcgatcgacggcgagtaccgcctgaagggcgagagccggaagaccttcgtggagctgatgcgccgcggggacctccccgtctggctggcccacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtacagcgaccccctggccctcaaggagttcaaggacttcgcggccggccgcaagtccatcgccctggacctggtgaccgagatcgggcgggtgccgagccacctcgcccaccgcacccggaacgccctggacaacctggtcatgctccacaccagcgagcacggcgggcgcgcgtaccggcacgccgtggaggagctgcccgagacgatggagaccctgctcctgctgggcctcatgatcctgctgaccgggggcgccatgctgttcctgatctccggcaaggggatcggcaagaccagcatcgggctgatctgcgtgatcgcctccagcggcatgctctggatggccgagatccccctgcagtggatcgcgtccgccatcgtcctggagttcttcatgatggtgctcctgatcccggagcccgagaagcagcgcacgccccaggacaaccagctggcctacgtggtcatcgggatcctcaccctggccgccatcatcgcggccaacgagatgggcctgctcgagaccaccaagcgggacctgggcatgagcaaggagcccggggtggtgtccccgacgagctacctggacgtcgacctccaccccgcctccgcctggaccctgtacgcggtggccaccaccgtgatcacgcccatgctgcgccacaccatcgagaacagcaccgccaacgtctccctcgccgccatcgcgaaccaggccgtggtgctgatgggcctggacaaggggtggcccatcagcaagatggacctcggcgtcccgctgctggccctcgggtgctactcccaggtgaaccccctgaccctgacggccgccgtgctcctgctgatcacccactacgcgatcatcggccccggcctccaggccaaggccacccgggaggcccagaagcgcaccgccgcggggatcatgaagaaccccacggtcgacggcatcatgaccatcgccctggacccggtgatctacgacagcaagttcgagaagcagctgggccaggtgatgctcctggtcctgtgcgccgtgcagctcctgctgatgcggacctcctgggccctctgcgaggcgctgaccctggccacgggccccatcaccaccctctgggagggcagccccgggaagttctggaacaccacgatcgccgtgtccatggccaacatcttccgcggcagctacctggccggggcgggcctggccttctccatcatgaagtccgtcgggaccggcaagcggggcaccgggagccagggcgagaccctcggggagaagtggaagaagaagctgaaccagctgtcccgcaaggagttcgacctctacaagaagtccggcatcaccgaggtggaccggacggaggccaaggaggggctgaagcgcggcgagaccacccaccacgccgtgtcccggggcagcgccaagctgcagtggttcgtcgagcgcaacatggtgatccccgaggggcgggtgatcgacctcggctgcgggcgcggcgggtggtcctactactgcgcgggcctgaagaaggtcaccgaggtgcggggctacacgaagggcgggccggggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccgcacgatccgcgtcctgaagatggtggagccctggctcaagaacaaccagttctgcatcaaggtgctgaacccctacatgcccaccgtcatcgagcacctggagcggctccagcgcaagcacggcgggatgctggtgcggaaccccctgagccgcaactccacccacgagatgtactggatcagcaacggcaccgggaacatcgtggcctccgtcaacatggtgagccggctcctgctgaaccgcttcacgatgacccaccggcgccccaccatcgagaaggacgtggacctcggcgccggcacccggcacgtcaacgccgagccggagacgcccaacatggacgtgatcggggagcgcatcaagcggatcaaggaggagcacaactccacctggcactacgacgacgagaacccctacaagacctgggcctaccacggcagctacgaggtgaaggcgaccgggtccgccagcagcatgatcaacggcgtcgtgaagctgctgacgaagccgtgggacgtcgtgcccatggtgacccagatggccatgaccgacaccacgcccttcgggcagcagcgcgtcttcaaggagaaggtggacacccggacgccccggtccatgccgggcacccggcgcgtgatgggcatcacgcccgagtggctctggcggcccctggggcgcaacaagaagccccggctgtgcccgcgcgaggagttcaccaagaaggtccgcaccaacgcccccatgggcgcggtgttcaccgaggagacgcagtgggccagcgccaaggccgccgtggaggacgaggacttctggaagctcgtcgaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtggagggggagggcctgcccaagctcggctacatcctgcgggacatcagcaagatccccgggggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatctcccggaaggaccagcgcggcagcggccaggtgggcacgtacgggctgaacaccttcaccaacatggaggcccagctcatccggcagatggagggcgagggggtgctgtccaaggcggacctggagaacccccacctcccggagaagaagatcacccagtggctggagacgaagggcgtcgagcgcctgaagcggatggccatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcgcggatctcccagggggccggctggagcctccgcgagaccgcctgcctgggcaaggcctacgcgcagatgtggtccctgatgtacttccaccgccgggacctccgcctggccagcaacgccatctgctccgccgtgcccgtgcactgggtcccgaccagccggaccacgtggagcatccacgcccaccaccagtggatgaccaccgaggacatgctgaccgtgtggaaccgcgtgtggatcgaggacaacccctggatggaggacaagacgcccgtcaccacctgggagaacgtgccgtacctcgggaagcgggaggaccagtggtgcggctccctgatcgggctgaccagccgcgcgacgtgggcccagaacatccccaccgccatccagcaggtccggtccctcatcggcaacgaggagttcctggactacatgcccagcatgaagcgcttccggaaggaggaggagtccgagggggccatctggtga

SEQ ID NO: 9982 - RNA, 9873 nt, synthetic construct
  misc_feature 1..9873: note = derived and/or modified CDS sequence (opt1) from DENV-3__GQ199887__SS-prME
  source 1..9873: mol_type = other RNA
accagcctgtgcctcatgatgatcctgcccgccgccctggcgttccacctcacctcccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagtacgagaacctcaagtacaccgtgatcatcacggtccacaccggggaccagcaccaggtgggcaacgagacccagggggtcaccgccgagatcacgccccaggcctccaccaccgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaaccgcaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcgtgaaggtcgagtacaagggcgaggacgcgccctgcaagatcccgttcagcaccgaggacgggcagggcaaggcccacaacggccgcctgatcacggccaaccccgtggtgaccaagaaggaggagcccgtcaacatcgaggccgagcccccgttcggggagtccaacatcgtgatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtgggcggggtcctcaactccctgggcaagatggtgcaccagatcttcgggagcgcctacacggccctgttctccggcgtgagctgggtcatgaagatcggcatcggggtgctcctgacctggatcggcctgaactccaagaacaccagcatgtccttcagctgcatcgccatcgggatcatcaccctctacctgggcgccgtggtccaggcggacatggggtgcgtgatcaactggaagggcaaggagctgaagtgcggctccgggatcttcgtgacgaacgaggtccacacctggaccgagcagtacaagttccaggccgacagccccaagcgcctcgccaccgccatcgccggcgcgtgggagaacggggtgtgcggcatccgctccacgacccggatggagaacctgctgtggaagcagatcgccaacgagctcaactacatcctgtgggagaacaacatcaagctgaccgtggtcgtgggggacaccatcggcgtgctcgagcagggcaagcgcacgctgacgccccagcccatggagctgaagtacagctggaagacctgggggaaggccaagatcgtcaccgccgagatccagaactccagcttcatcatcgacggcccgaacacgcccgagtgcccctccgcgagccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagtcccagaagaacgggagctggaagctggagaaggcctccttcatcgaggtgaagacctgcacgtggcccaagagccacaccctgtggtccaacggcgtgctcgagagcgacatgatcatcccgaagtccctggccgggcccatcagccagcacaactaccggcccggctaccacacccagaccgccgggccgtggcacctgggcaagctcgagctggacttcaactactgcgagggcacgaccgtcgtgatcaccgagaactgcgggacccgcggcccctccctgcggacgaccaccgtgagcgggaagctcatccacgagtggtgctgccgctcctgcaccctgccgcccctccggtacatgggcgaggacgggtgctggtacggcatggagatccgcccgatcagcgagaaggaggagaacatggtcaagtccctcgccagcgcgggctccgggaaggtggacaacttcacgatgggcgtgctgtgcctggccatcctcttcgaggaggtcatgcgggggaagttcggcaagaagcacatgatcgccggggtgttcttcaccttcgtgctgctgctcagcggccagatcacctggcgcgacatggcccacaccctgatcatgatcggctccaacgccagcgaccggatggggatgggcgtcacgtacctggcgctcatcgccaccttcaagatccagcccttcctggccctggggttcttcctccgcaagctgaccagccgggagaacctgctcctgggcgtgggcctggccatggcgaccacgctccagctgcccgaggacatcgagcagatggccaacgggatcgccctgggcctcatggccctgaagctgatcacccagttcgagacctaccagctctggaccgccctggtgtccctgacgtgcagcaacaccatgttcaccctcaccgtcgcgtggcgcacggccaccctgatcctggccggggtgtccctcctgcccgtctgccagagctccagcatgcggaagaccgactggctgccgatgaccgtggccgccatgggcgtgccgcccctccccctgttcatcttctccctgaaggacacgctcaagcgccgcagctggccgctgaacgagggggtcatggcggtgggcctggtgtccatcctcgccagctccctgctgcggaacgacgtccccatggccggccccctcgtggccgggggcctgctgatcgcctgctacgtgatcaccgggaccagcgcggacctcaccgtcgagaaggccgccgacgtgacgtgggaggaggaggccgagcagaccggcgtgtcccacaacctgatgatcaccgtcgacgacgacgggaccatgcgcatcaaggacgacgagaccgagaacatcctgacggtgctcctgaagaccgccctgctcatcgtgagcggcatcttcccctactccatcccggcgaccctgctggtctggcacacctggcagaagcagacgcagcggagcggcgtgctctgggacgtgcccagcccgcccgagacccagaaggccgagctggaggagggggtctaccgcatcaagcagcagggcatcctggggaagacccaggtgggcgtgggggtccagaaggagggcgtgttccacaccatgtggcacgtgacgcggggcgccgtcctcacccacaacgggaagcgcctggagccgaactgggccagcgtgaagaaggacctgatctcctacggcgggggctggcggctcagcgcgcagtggcagaagggggaggaggtgcaggtcatcgccgtggagcccggcaagaaccccaagaacttccagaccatgcccggcaccttccagacgaccaccggggagatcggcgccatcgccctggacttcaagccggggaccagcggctcccccatcatcaaccgcgagggcaaggtggtcgggctgtacggcaacggggtggtgacgaagaacggcgggtacgtcagcggcatcgcccagaccaacgcggagcccgacggcccgacccccgagctggaggaggagatgttccggaagcgcaacctcaccatcatggacctgcaccccgggtccggcaagacgcggaagtacctgcccgccatcgtgcgcgaggccatcaagcggcgcctccggaccctgatcctggccccgacccgcgtggtcgccgcggagatggaggaggccctcaaggggctgcccatccggtaccagaccacggccaccaagagcgagcacaccggccgcgagatcgtggacctgatgtgccacgccaccttcacgatgcggctcctgtcccccgtgcgcgtccccaactacaacctgatcatcatggacgaggcccacttcaccgacccggcgagcatcgccgcccgggggtacatctccacccgcgtgggcatgggcgaggccgcggccatcttcatgaccgccacgccgcccgggaccgccgacgccttcccccagagcaacgcgccgatccaggacgaggagcgcgacatccccgagcggtcctggaacagcggcaacgagtggatcaccgacttcgccgggaagaccgtgtggttcgtcccctccatcaaggccggcaacgacatcgccaactgcctccgcaagaacgggaagaaggtgatccagctgagccggaagacgttcgacaccgagtaccagaagaccaagctgaacgactgggacttcgtggtcaccacggacatctccgagatgggcgccaacttcaaggcggaccgcgtgatcgacccccggcgctgcctcaagccggtgatcctgaccgacggccccgagcgggtcatcctggccgggcccatgcccgtgaccgccgccagcgccgcgcagcgccggggccgcgtggggcggaacccgcagaaggagaacgaccagtacatcttcaccggccagcccctcaacaacgacgaggaccacgcccactggaccgaggccaagatgctgctggacaacatcaacacgcccgaggggatcatccccgccctcttcgagccggagcgcgagaagtccgcggccatcgacggcgagtaccggctgaagggcgagagccgcaagaccttcgtcgagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtacagcgaccccctggcgctcaaggagttcaaggacttcgccgccggccggaagtccatcgccctggacctggtgaccgagatcgggcgcgtcccgagccacctcgcccaccggacccgcaacgcgctggacaacctggtgatgctccacaccagcgagcacggcgggcgggcctaccgccacgccgtggaggagctgcccgagacgatggagaccctgctcctgctgggcctcatgatcctgctgaccgggggcgtcatgctgttcctgatctccggcaaggggatcggcaagaccagcatcgggctgatctgcgtgatcgcctccagcggcatgctctggatggccgacgtgcccctgcagtggatcgcgtccgccatcgtcctggagttcttcatgatggtgctcctgatcccggagcccgagaagcagcggacgccccaggacaaccagctggcctacgtggtcatcgggatcctcaccctggccgccatcatcgcggccaacgagatgggcctgctcgagaccaccaagcgcgacctgggcatgagcaaggagcccggggtggtgtccccgacgagctacctggacgtcgacctccaccccgcctccgcctggaccctgtacgcggtggccaccaccgtgatcacgcccatgctgcggcacaccatcgagaacagcaccgccaacgtctccctcgccgccatcgcgaaccaggccgtggtgctgatgggcctggacaaggggtggcccatcagcaagatggacctcggcgtcccgctgctggccctcgggtgctactcccaggtgaaccccctgaccctgacggccgccgtgctcctgctgatcacccactacgcgatcatcggccccggcctccaggccaaggccacccgcgaggcccagaagcggaccgccgcggggatcatgaagaaccccacggtcgacggcatcatgaccatcgacctggacccggtgatctacgacagcaagttcgagaagcagctgggccaggtgatgctcctggtcctgtgcgccgtgcagctcctgctgatgcgcacctcctgggccctctgcgaggccctgaccctggcgacgggccccatcaccaccctctgggagggcagccccgggaagttctggaacaccacgatcgccgtgtccatggccaacatcttccggggcagctacctggccggggccggcctggcgttctccatcatgaagtccgtcgggaccggcaagcgcggcaccgggagccagggcgagaccctcggggagaagtggaagaagaagctgaaccagctgagccggaaggagttcgacctctacaagaagtccggcatcaccgaggtggaccgcacggaggccaaggaggggctgaagcggggcgagaccacccaccacgccgtgtcccgcggcagcgccaagctgcagtggttcgtcgagcggaacatggtgatccccgaggggcgcgtgatcgacctcggctgcgggcggggcgggtggtcctactactgcgccggcctgaagaaggtcaccgaggtgcgcggctacacgaagggcgggccggggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccgcacgatccgggtcctgaagatggtggagccctggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcaccgggaacatcgtgtccagcgtcaacatggtgtcccgcctcctgctgaaccggttcacgatgacccaccgccggcccaccatcgagcgcgacgtggacctcggcgcgggcacccggcacgtcaacgccgagccggagatccccaacatggacgtgatcggggagcgcatcaagcggatcaaggaggagcacaacagcacgtggcactacgacgacgagaacccctacaagacctgggcctaccacggctcctacgaggtcaaggccaccgggagcgccagctccatgatcaacggcgtggtgaagctgctgaccaagccgtgggacgtcgtgcccatggtgacgcagatggcgatgaccgacaccacccccttcgggcagcagcgcgtcttcaaggagaaggtggacacgcggacgccccggccgatgcccggcacccggaaggtgatggagatcaccgccgagtggctctggcgcacgctgggccggaacaagcgcccccgcctgtgcacccgggaggagttcaccaagaaggtccgcaccaacgccgccatgggggcggtgttcacggaggagaaccagtgggacagcgccaaggccgccgtggaggacgaggagttctggaagctcgtcgaccgggagcgcgagctgcacaagctgggcaagtgcgggtcctgcgtgtacaacatgatgggcaagcgggagaagaagctcggggagttcggcaaggccaagggcagccgcgcgatctggtacatgtggctgggggcccggtacctggagttcgaggccctcggcttcctgaacgaggaccactggttctcccgcgagaacagctactccggggtggagggcgaggggctgcacaagctcggctacatcctgcgggacatcagcaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccgggaccgtcatggacatcatctcccggaaggaccagcgcggcagcggccaggtggggacgtacggcctgaacaccttcaccaacatggaggcccagctcgtgcggcagatggagggggagggcgtcctgtccaaggccgacctggagaacccccacctcctggagaagaagatcacccagtggctggagacgaagggggtggagcgcctcaagcggatggcgatcagcggcgacgactgcgtggtcaagccgatcgacgaccgcttcgccaacgccctgctggccctcaacgacatgggcaaggtgcggaaggacatcccccagtggcagccctccaaggggtggcacgactggcagcaggtccccttctgcagccaccacttccacgagctgatcatgaaggacggccgcaagctggtcgtgccgtgccggccccaggacgagctcatcgggcgcgcccgcatctcccagggcgcggggtggagcctgcgggagaccgcctgcctgggcaaggcctacgcccagatgtggtccctcatgtacttccaccgccgggacctgcgcctggcgagcaacgccatctgctccgccgtgcccgtccactgggtgcccaccagccggaccacgtggagcatccacgcccaccaccagtggatgaccaccgaggacatgctcaccgtgtggaaccgcgtctggatcgaggacaacccgtggatggaggacaagacgcccgtgaccacctgggagaacgtgccctacctgggcaagcgggaggaccagtggtgcgggtccctgatcggcctcaccagccgcgccacgtgggcgcagaacatccccaccgccatccagcaggtccggtccctgatcgggaacgaggagttcctggactacatgccgagcatgaagcgcttccggaaggaggaggagtccgagggcgccatctggtga

SEQ ID NO: 9983 - RNA, 9873 nt, synthetic construct
  misc_feature 1..9873: note = derived and/or modified CDS sequence (opt1) from DENV-3__GQ199888__SS-prME
  source 1..9873: mol_type = other RNA
accagcctgtgcctcatgatgatcctgcccgccgccctggcgttccacctcacctcccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagtacgagaacctcaagtacaccgtgatcatcacggtccacaccggggaccagcaccaggtgggcaacgagacccagggggtcaccgccgagatcacgccccaggcctccaccaccgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaaccgcaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcgtgaaggtcgagtacaagggcgaggacgcgccctgcaagatcccgttcagcaccgaggacgggcagggcaaggcccacaacggccgcctgatcacggccaaccccgtggtgaccaagaaggaggagcccgtcaacatcgaggccgagcccccgttcggggagtccaacatcgtgatcggcaccggggacaacgcgctgaagatcaactggtacaagaagggcagctccatcgggaagatgttcgaggccaccgcccggggcgcccgccggatggccatcctgggcgacacggcgtgggacttcgggagcgtgggcggggtcctcaactccctgggcaagatggtgcaccagatcttcgggagcgcctacaccgccctgttctccggcgtgagctgggtcatgaagatcggcatcggggtgctcctgacctggatcggcctgaactccaagaacaccagcatgtccttcagctgcatcgccatcgggatcatcacgctctacctgggcgccgtggtccaggcggacatggggtgcgtgatcaactggaagggcaaggagctgaagtgcggctccgggatcttcgtgaccaacgaggtccacacctggaccgagcagtacaagttccaggccgacagccccaagcgcctcgccacggccatcgccggcgcgtgggagaacggggtgtgcggcatccgctccaccacccggatggagaacctgctgtggaagcagatcgccaacgagctcaactacatcctgtgggagaacaacatcaagctgaccgtggtcgtgggggacacgatcggcgtgctcgagcagggcaagcgcaccctgacgccccagcccatggagctgaagtacagctggaagacctgggggaaggccaagatcgtcacggccgagatccagaactccagcttcatcatcgacggcccgaacacccccgagtgcccctccgcgagccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagtcccagaagaacgggagctggaagctggagaaggcctccttcatcgaggtgaagacgtgcacctggcccaagagccacaccctgtggtccaacggcgtgctcgagagcgacatgatcatcccgaagtccctggccgggcccatcagccagcacaactaccggcccggctaccacacccagacggccgggccgtggcacctgggcaagctcgagctggacttcaactactgcgagggcaccaccgtcgtgatcaccgagaactgcgggacgcgcggcccctccctgcggaccaccaccgtgagcgggaagctcatccacgagtggtgctgccgctcctgcacgctgccgcccctccggtacatgggcgaggacgggtgctggtacggcatggagatccgcccgatcagcgagaaggaggagaacatggtcaagtccctcgccagcgcgggctccgggaaggtggacaacttcaccatgggcgtgctgtgcctggccatcctcttcgaggaggtcatgcgggggaagttcggcaagaagcacatgatcgccggggtgttcttcaccttcgtgctgctgctcagcggccagatcacctggcgcgacatggcccacacgctgatcatgatcggctccaacgccagcgaccggatggggatgggcgtcacctacctggcgctcatcgccaccttcaagatccagcccttcctggccctggggttcttcctccgcaagctgaccagccgggagaacctgctcctgggcgtgggcctggccatggcgacgaccctccagctgcccgaggacatcgagcagatggccaacgggatcgccctgggcctcatggccctgaagctgatcacccagttcgagacctaccagctctggacggccctggtgtccctgacctgcagcaacaccatgttcaccctcacggtcgcgtggcgcaccgccaccctgatcctggccggggtgtccctcctgcccgtctgccagagctccagcatgcggaagaccgactggctgccgatgacggtggccgccatgggcgtgccgcccctccccctgttcatcttctccctgaaggacaccctcaagcgccgcagctggccgctgaacgagggggtcatggcggtgggcctggtgtccatcctcgccagctccctgctgcggaacgacgtccccatggccggccccctcgtggccgggggcctgctgatcgcctgctacgtgatcaccgggaccagcgcggacctcacggtcgagaaggccgccgacgtgacctgggaggaggaggccgagcagaccggcgtgtcccacaacctgatgatcaccgtcgacgacgacgggaccatgcgcatcaaggacgacgagacggagaacatcctgaccgtgctcctgaagaccgccctgctcatcgtgagcggcatcttcccctactccatcccggcgaccctgctggtctggcacacgtggcagaagcagacccagcggagcggcgtgctctgggacgtgcccagcccgcccgagacccagaaggccgagctggaggagggggtctaccgcatcaagcagcagggcatcctggggaagacccaggtgggcgtgggggtccagaaggagggcgtgttccacacgatgtggcacgtgacccggggcgccgtcctcacccacaacgggaagcgcctggagccgaactgggccagcgtgaagaaggacctgatctcctacggcgggggctggcggctcagcgcgcagtggcagaagggggaggaggtgcaggtcatcgccgtggagcccggcaagaaccccaagaacttccagaccatgcccggcacgttccagaccaccaccggggagatcggcgccatcgccctggacttcaagccggggacgagcggctcccccatcatcaaccgcgagggcaaggtggtcgggctgtacggcaacggggtggtgaccaagaacggcgggtacgtcagcggcatcgcccagaccaacgcggagcccgacggcccgacccccgagctggaggaggagatgttccggaagcgcaacctcacgatcatggacctgcaccccgggtccggcaagacccggaagtacctgcccgccatcgtgcgcgaggccatcaagcggcgcctccggaccctgatcctggccccgacccgcgtggtcgccgcggagatggaggaggccctcaaggggctgcccatccggtaccagacgaccgccaccaagagcgagcacaccggccgcgagatcgtggacctgatgtgccacgccacgttcaccatgcggctcctgtcccccgtgcgcgtccccaactacaacctgatcatcatggacgaggcccacttcaccgacccggcgagcatcgccgcccgggggtacatctccacccgcgtgggcatgggcgaggccgcggccatcttcatgacggccacgccgcccgggaccgccgacgccttcccccagagcaacgcgccgatccaggacgaggagcgcgacatccccgagcggtcctggaacagcggcaacgagtggatcaccgacttcgccgggaagacggtgtggttcgtcccctccatcaaggccggcaacgacatcgccaactgcctccgcaagaacgggaagaaggtgatccagctgagccggaagaccttcgacaccgagtaccagaagaccaagctgaacgactgggacttcgtggtcacgaccgacatctccgagatgggcgccaacttcaaggcggaccgcgtgatcgacccccggcgctgcctcaagccggtgatcctgaccgacggccccgagcgggtcatcctggccgggcccatgcccgtgaccgccgccagcgccgcgcagcgccggggccgcgtggggcggaacccgcagaaggagaacgaccagtacatcttcaccggccagcccctcaacaacgacgaggaccacgcccactggacggaggccaagatgctgctggacaacatcaacacccccgaggggatcatccccgccctcttcgagccggagcgcgagaagtccgcggccatcgacggcgagtaccggctgaagggcgagagccgcaagaccttcgtcgagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctacagcgaccccctggcgctcaaggagttcaaggacttcgccgccggccggaagtccatcgccctggacctggtgaccgagatcgggcgcgtcccgagccacctcgcccaccggacccgcaacgcgctggacaacctggtgatgctccacacgagcgagcacggcgggcgggcctaccgccacgccgtggaggagctgcccgagaccatggagaccctgctcctgctgggcctcatgatcctgctgaccgggggcgccatgctgttcctgatctccggcaaggggatcggcaagacgagcatcgggctgatctgcgtcatcgcctccagcggcatgctctggatggcggacgtgcccctgcagtggatcgcctccgccatcgtgctggagttcttcatgatggtcctcctgatcccggagcccgagaagcagcggacgccccaggacaaccagctggcctacgtggtgatcgggatcctcaccctggccgcgatcatcgccgccaacgagatgggcctgctcgagaccacgaagcgcgacctgggcatgagcaaggagcccggggtcgtgtccccgaccagctacctggacgtggacctccaccccgcctccgcgtggaccctgtacgccgtcgccaccacggtgatcacccccatgctgcggcacaccatcgagaacagcaccgccaacgtgtccctcgccgcgatcgccaaccaggccgtcgtgctgatgggcctggacaaggggtggcccatcagcaagatggacctcggcgtgccgctgctggccctcgggtgctactcccaggtcaaccccctgacgctgaccgccgcggtgctcctgctgatcacccactacgccatcatcggccccggcctccaggccaaggccacccgcgaggcccagaagcggacggcggccgggatcatgaagaaccccaccgtggacggcatcatgaccatcgacctggacccggtcatctacgacagcaagttcgagaagcagctgggccaggtgatgctcctggtgctgtgcgccgtccagctcctgctgatgcgcacctcctgggccctctgcgaggcgctgacgctggccaccggccccatcaccaccctctgggagggcagccccgggaagttctggaacacgaccatcgccgtgtccatggccaacatcttccggggcagctacctggccggggcgggcctggccttctccatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggccaaggaggggctgaagcggggcgagaccacccaccacgccgtgtcccgcggcagcgccaagctgcagtggttcgtggagcggaacatggtcatccccgaggggcgcgtgatcgacctcggctgcgggcggggcgggtggtcctactactgcgcgggcctgaagaaggtgacggaggtccgcggctacaccaagggcgggccggggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccacggtggaggagtcccgcaccatccgggtgctgaagatggtcgagccctggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcacggggaacatcgtgtccagcgtgaacatggtctcccgcctcctgctgaaccggttcaccatgacccaccgccggcccaccatcgagcgcgacgtggacctcggcgccggcacgcggcacgtgaacgccgagccggagatccccaacatggacgtcatcggggagcgcatcaagcggatcaaggaggagcacaacagcacctggcactacgacgacgagaacccctacaagacctgggcctaccacggctcctacgaggtgaaggccaccgggagcgcgagctccatgatcaacggcgtcgtgaagctgctgacgaagccgtgggacgtggtccccatggtgacccagatggccatgaccgacaccacgcccttcgggcagcagcgcgtgttcaaggagaaggtcgacacccggacgccccggccgatgcccggcacccggaaggtgatggagatcacggccgagtggctctggcgcaccctgggccggaacaagcgcccccgcctgtgcacccgggaggagttcaccaagaaggtgcgcacgaacgccgcgatgggggccgtcttcaccgaggagaaccagtgggacagcgccaaggccgccgtggaggacgaggagttctggaagctcgtggaccgggagcgcgagctgcacaagctgggcaagtgcgggtcctgcgtctacaacatgatgggcaagcgggagaagaagctcggggagttcggcaaggcgaagggcagccgcgccatctggtacatgtggctgggggcccggtacctggagttcgaggccctcggcttcctgaacgaggaccactggttctcccgcgagaacagctactccggggtggagggcgaggggctgcacaagctcggctacatcctgcgggacatcagcaagatccccggcggggccatgtacgcggacgacaccgccggctgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccgggacggtgatggacatcatctcccggaaggaccagcgcggcagcggccaggtcgggacctacggcctgaacaccttcaccaacatggaggcccagctcgtgcggcagatggagggggaggacgtgctgtccaaggcggacctggagaacccccacctcctggagaagaagatcacgcagtggctggagaccaagggcgtcgagcgcctcaagcggatggccatcagcggggacgactgcgtggtgaagccgatcgacgaccgcttcgccaacgccctgctggccctcaacgacatgggcaaggtccggaaggacatcccccagtggcagccctccaagggctggcacgactggcagcaggtccccttctgcagccaccacttccacgagctgatcatgaaggacgggcgcaagctggtggtcccgtgccggccccaggacgagctcatcggccgcgcgcgcatctcccagggggccggctggagcctgcgggagaccgcctgcctggggaaggcctacgcgcagatgtggtccctcatgtacttccaccgccgggacctgcgcctggccagcaacgccatctgctccgccgtgcccgtgcactgggtccccaccagccggacgacctggagcatccacgcccaccaccagtggatgaccaccgaggacatgctcacggtgtggaaccgcgtgtggatcgaggacaacccgtggatggaggacaagacccccgtcaccacctgggagaacgtgccctacctgggcaagcgggaggaccagtggtgcggctccctgatcgggctcacgagccgcgcgacctgggcccagaacatccccaccgccatccagcaggtccggtccctgatcggcaacgaggagttcctggactacatgccgagcatgaagcgcttccggaaggaggaggagtccgagggggccatctggtga

SEQ ID NO: 9984 - RNA, 9873 nt, synthetic construct
  misc_feature 1..9873: note = derived and/or modified CDS sequence (opt1) from DENV-3__GQ252674__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtggggatcggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgcgccgtgcaagatccccttcagcaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacaccatcggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtgtgggaggtcgaggactacgggttcggcgtgttcaccaccaacatctggctcaagctgcgcgacgtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggccgggcccatctcccagcacaactaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgcgatcctgttcgaggaggtgatgcgggggaagttcggcaagaagcacatgatcgccggggtcctgttcaccttcgtgctcctgctgtccggccagatcacctggcgcgacatggcccacacgctcatcatgatcggcagcaacgcctccgaccggatggggatgggcgtgacctacctggccctgatcgcgaccttcaagatccagcccttcctcgccctggggttcttcctgcgcaagctcaccagccgggagaacctgctgctcggcgtcggcctggccatggccacgaccctgcagctccccgaggacatcgagcagatggcgaacgggatcgccctgggcctgatggccctcaagctgatcacccagttcgagacctaccagctgtggacggccctcgtgagcctgacctgctccaacaccatcctgaccctcacggtggcctggcgcaccgcgaccctgatcctggccggggtcagcctcctgccggtgtgccagtccagctccatgcggaagaccgactggctgcccatgacggtcgccgccatgggcgtgccgcccctcccgctgttcatcttcagcctgaaggacaccctcaagcgccgctcctggcccctgaacgagggggtgatggccgtcggcctggtgagcatcctcgcgtccagcctgctgcggaacgacgtgcccatggccggccccctcgtcgccgggggcctgctgatcgcctgctacgtgatcaccgggacctccgccgacctcacggtggagaacgcggccgacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggcggagctggaggagggggtgtaccgcatcaagcagcagggcatcttcgggaagacccaggtcggcgtgggggtgcagaaggagggcgtcttccacacgatgtggcacgtgacccggggcgccgtgctgacccacaacgggaagcgcctcgagcccaactgggcctccgtcaagaaggacctgatcagctacggcgggggctggcggctgtccgcccagtggcagcgcggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgggagggcaaggtggtggggctctacggcaacggggtcgtgaccaagaacggcgggtacgtgtccggcatcgcccagaccaacgccgagccggacggccccacccccgagctggaggaggagatgttcaagaagcgcaacctgacgatcatggacctccaccccgggagcggcaagacccggaagtacctgccggcgatcgtccgcgaggccatcaagcggcgcctgcggaccctcatcctggcccccacccgcgtggtggccgccgagatggaggaggcgctgaaggggctccccatccggtaccagacgaccgccaccaagtccgagcacaccggccgcgagatcgtcgacctgatgtgccacgccacgttcaccatgcggctgctcagccccgtgcgcgtgccgaactacaacctgatcatcatggacgaggcccacttcaccgaccccgcctccatcgcggcccgggggtacatcagcacccgcgtcggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtgtggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgccaacttcaaggccgaccgcgtcatcgacccgcggcgctgcctgaagcccgtgatcctcaccgacggccccgagcgggtgatcctggcggggcccatcccggtcaccgccgcctccgccgcccagcgccggggccgcgtggggcggaacccccagaaggagaacgaccagtacatcttcaccggccagcccctgaacaacgacgaggaccacgcgcactggacggaggccaagatgctcctggacaacatcaacacccccgaggggatcatcccggccctgttcgagcccgagcgcgagaagtccgccgcgatcgacggcgagtaccggctcaagggcgagtcccgcaagaccttcgtggagctgatgcggcgcggggacctgcccgtctggctcgcccacaaggtggccagcgagggcatcaagtacaccgaccggaagtggtgcttcgacgggcagcgcaacaaccagatcctggaggagaacatggacgtcgagatctggacgaaggagggcgagaagaagaagctgcggccccgctggctcgacgcccgcacctactccgacccgctggccctgaaggagttcaaggacttcgcggccggccgcaagagcatcgccctcgacctggtgaccgagatcgggcgcgtgccctcccacctggcccaccggacccgcaacgccctcgacaacctggtcatgctgcacacgagcgagcacggcgggcgggcgtaccgccacgccgtggaggagctccccgagaccatggagaccctgctgctcctgggcctgatgatcctcctgaccgggggcgccatgctgttcctcatcagcggcaaggggatcggcaagacgtccatcgggctgatctgcgtgatcgccagctccggcatgctgtggatggccgagatcccgctccagtggatcgcgagcgccatcgtcctggagttcttcatgatggtgctgctcatccccgagcccgagaagcagcggacgccccaggacaaccagctggcctacgtggtcatcgggatcctgaccctcgccgccatcatcgcggccaacgagatgggcctgctggagaccacgaagcgcgacctcggcatgtccaaggagccgggggtggtgagccccacctcctacctggacgtcgacctgcaccccgccagcgcctggaccctctacgcggtggccaccacggtgatcacccccatgctgcggcacaccatcgagaactccaccgccaacgtcagcctggccgccatcgcgaaccaggccgtggtgctcatgggcctggacaaggggtggccgatctccaagatggacctgggcgtccccctcctggccctggggtgctacagccaggtgaaccccctcacgctgaccgccgccgtgctgctcctgatcacccactacgcgatcatcggccccggcctgcaggccaaggccacccgcgaggcccagaagcggacggccgcggggatcatgaagaacccgaccgtcgacggcatcatgaccatcgacctcgaccccgtgatctacgactccaagttcgagaagcagctgggccaggtgatgctgctcgtcctgtgcgccgtgcagctgctcctgatgcgcaccagctgggccctgtgcgaggccctcacgctggcgaccggccccatcaccaccctgtgggagggctcccccgggaagttctggaacacgaccatcgccgtgagcatggccaacatcttccggggctcctacctcgccggggccggcctggcgttcagcatcatgaagtccgtcgggaccggcaagcgcggcaccgggagccagggcgagaccctgggggagaagtggaagaagaagctcaaccagctgagccggaaggagttcgacctgtacaagaagtccggcatcacggaggtggaccgcaccgaggccaaggaggggctcaagcggggcgagatcacccaccacgccgtgagccgcggctccgccaagctgcagtggttcgtcgagcggaacatggtgatcccggaggggcgcgtgatcgacctgggctgcgggcggggcgggtggagctactactgcgccggcctcaagaaggtcaccgaggtgcgcggctacacgaagggcgggcccgggcacgaggagcccgtgcccatgtccacctacggctggaacatcgtcaagctgatgagcgggaaggacgtgttctacctgccgcccgagaagtgcgacaccctgctctgcgacatcggcgagtccagcccctcccccaccgtggaggagagccgcacgatccgggtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgtcccggaacagcacccacgagatgtactggatctccaacggcaccgggaacatcgtgagctccgtcaacatggtgagccgcctgctcctgaaccggttcacgatgacccaccgccggccgaccatcgagaaggacgtggacctgggcgcgggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggccaccgggtccgccagcagcatgatcaacggcgtcgtgaagctcctgacgaagccctgggacgtcgtgcccatggtgacccagatggcgatgaccgacaccacgcccttcgggcagcagcgggtcttcaaggagaaggtggacacccgcaccccgcggtccatgcccggcacccgcaaggtgatgggcatcacggccgagtggctgtggcggaccctcgggcgcaacaagcggccccgcctgtgcacccgcgaggagttcaccaagaaggtccggacgaacgccgccatgggcgcggtgttcaccgaggagaaccagtgggacagcgccaaggccgccgtggaggacgaggagttctggaagctggtcgaccgcgagcgggagctccacaagctggggaagtgcggctcctgcgtgtacaacatgatggggaagcgcgagaagaagctgggcgagttcggcaaggccaaggggagccgggcgatctggtacatgtggctcggcgcccgctacctggagttcgaggccctggggttcctcaacgaggaccactggttctcccgggacaacagctactccggcgtggagggggagggcctgcacaagctgggctacatcctccgcgacatcagcaagatccccgggggcgccatgtacgccgacgacaccgcggggtgggacacccggatcacggaggacgacctgcacaacgaggagaagatcacccagcagatggacccggagcaccgccagctggccaacgccatcttcaagctcacctaccagaacaaggtcgtgaaggtgcagcggcccacccccaccggcacggtcatggacatcatctcccgcaaggaccagcggggcagcggccaggtgggcacctacgggctgaacaccttcaccaacatggaggtgcagctggtccgccagatggagggcgagggggtgctctccaaggccgacctggagaacccccacctccccgagaagaagatcacgcagtggctggagaccaagggcgtggagcggctgaagcgcatggccatcagcggcgacgactgcgtcgtgaagcccatcgacgaccggttcgcgaacgccctgctcgccctgaacgacatggggaaggtgcgcaaggacatcccccagtggcagccctccaagggctggcacgactggcagcaggtcccgttctgcagccaccacttccacgagctgatcatgaaggacgggcggaagctcgtggtgccctgccgcccccaggacgagctgatcggccgggcccgcatctcccagggggccggctggagcctgcgcgagaccgcgtgcctcggcaaggcctacgcccagatgtggtccctgatgtacttccaccggcgcgacctgcggctcgccagcaacgcgatctgctccgccgtccccgtgcactgggtgccgaccagccgcacgacctggagcatccacgcccaccaccagtggatgaccaccgaggacatgctgacggtctggaaccgggtgtggatcgaggacaacccctggatggagaacaagacccccgtgaccacctgggagaacgtcccctacctggggaagcgcgaggaccagtggtgcggctccctcatcgggctgacgagccgggccacctgggcccagaacatcccgaccgcgatccagcaggtccgctccctgatcggcaacgaggagttcctcgactacatgcccagcatgaagcggttccgcaaggaggaggagtccgagggggccatctggtga

SEQ ID NO: 9985 - RNA, 9873 nt, synthetic construct
  misc_feature 1..9873: note = derived and/or modified CDS sequence (opt1) from DENV-3__GQ199889__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccaccccgggttcaccatcctcgcgctgttcctggcccactacatcggcacctccctcacccagaaggtggtgatcttcatcctgctgatcctcgtcacgcccagcatggccatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccatcctgcccgaggagcaggaccagaactacgtgtgcaagcacacgtacgtcgaccgggggtggggcaacgggtgcggcctcttcgggaagggctccctggtgacctgcgccaagttccagtgcctggagagcatcgagggcaaggtggtccagtacgagaacctcaagtacaccgtgatcatcaccgtgcacacgggggaccagcaccaggtcggcaacgagacccagggggtgaccgccgagatcacgccccaggcgtccacgaccgaggccatcctgcccgagtacggcaccctggggctcgagtgcagcccccgcaccggcctggacttcaacgagatgatcctgctcaccatgaagaacaaggcctggatggtccaccggcagtggttcttcgacctgccgctgccctggacgtccggcgccaccaccgagacccccacgtggaaccgcaaggagctcctggtgaccttcaagaacgcccacgcgaagaagcaggaggtggtcgtgctggggagccaggagggcgccatgcacaccgccctcaccggggccacggagatccagaactccggcgggaccagcatcttcgccggccacctgaagtgccggctgaagatggacaagctcgagctgaagggcatgtcctacgcgatgtgcaccaacaccttcgtgctgaagaaggaggtcagcgagacgcagcacgggaccatcctcatcaaggtggagtacaagggcgaggacgccccctgcaagatccccttcagcaccgaggacgggcagggcaaggcccacaacggccgcctgatcaccgccaaccccgtggtcacgaagaaggaggagcccgtgaacatcgaggcggagcccccgttcggggagtccaacatcgtgatcggcatcggggacaacgccctgaagatcaactggtacaagaagggcagctccatcgggaagatgttcgaggccaccgcccggggcgcccgccggatggcgatcctgggcgacaccgcctgggacttcgggagcgtcggcggggtgctcaactccctgggcaagatggtgcaccagatcttcgggagcgcctacaccgccctgttctccggcgtcagctgggtgatgaagatcggcatcggggtgctcctgacgtggatcggcctgaactccaagaacaccagcatgtccttcagctgcatcgccatcgggatcatcaccctctacctgggcgcggtcgtgcaggccgacaccgggtgcgtgatcaactggaagggcaaggagctgaagtgcggctccgggatcttcgtcacgaacgaggtgcacacctggaccgagcagtacaagttccaggccgacagccccaagcgcctcgccaccgccatcgcgggcgcctgggagaacggggtgtgcggcatccgctccacgacccggatggagaacctgctgtggaagcagatcgccaacgagctcaactacatcctgtgggagaacaacatcaagctgaccgtcgtggtgggggacaccatcggcgtcctcgagcagggcaagcgcacgctgacgccccagcccatggagctgaagtacagctggaagacctgggggaaggccaagatcgtgaccgcggagatccagaactccagcttcatcatcgacggcccgaacacgcccgagtgcccctccgccagccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgcggtgcacgccgacatgggctactggatcgagtcccagaagaacgggagctggaagctggagaaggcctccttcatcgaggtgaagacctgcacgtggcccaagagccacaccctgtggtccaacggcgtcctcgagagcgacatgatcatcccgaagtccctggccgggcccatcagccagcacaactaccggcccggctaccacacccagaccgccgggccgtggcacctgggcaagctcgagctggacttcaactactgcgagggcacgaccgtggtgatcaccgagaactgcgggacccgcggcccctccctgcggacgaccaccgtcagcgggaagctcatccacgagtggtgctgccgctcctgcaccctgccgcccctgcggtacatgggcgaggacgggtgctggtacggcatggagatccgcccgatcagcgagaaggaggagaacatggtgaagtccctcgcgagcgccggctccgggaaggtggacaacttcacgatgggcgtcctgtgcctggccatcctcttcgaggaggtgatgcgggggaagttcggcaagaagcacatgatcgccggggtgttcttcaccttcgtcctgctgctcagcggccagatcacctggcgcgacatggcccacaccctgatcatgatcggctccaacgcgagcgaccggatggggatgggcgtgacgtacctggccctcatcgccaccttcaagatccagcccttcctggccctggggttcttcctccgcaagctgaccagccgggagaacctgctcctgggcgtgggcctggcgatggccaccacgctccagctgcccgaggacatcgagcagatggccaacgggatcgccctgggcctcatggccctgaagctgatcacccagttcgagacctaccagctctggaccgcgctgatctccctgacgtgcagcaacaccatgttcaccctcaccgtcgcctggcgcacggccaccctgatcctggccggggtgtccctcctgcccgtgtgccagagctccagcatgcggaagaccgactggctgccgatgaccgtcgccgcgatgggcgtgccgcccctgcccctgttcatcttctccctgaaggacacgctcaagcgccgcagctggccgctgaacgagggggtcatggccgtgggcctggtgtccatcctcgccagctccctgctgcggaacgacgtccccatggccggccccctcgtggccgggggcatgctgatcgcgtgctacgtgatcaccgggaccagcgccgacctgaccgtcgagaaggccgccgacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgcgctgctgatcgtgagcggcatcttcccctactccatcccggccaccctcctggtctggcacacctggcagaagcagacgcagcggagcggcgtgctgtgggacgtgcccagcccgcccgagacccagaaggccgagctcgaggagggggtctaccgcatcaagcagcagggcatcctggggaagacccaggtgggcgtgggggtccagaaggagggcgtgttccacaccatgtggcacgtgacgcggggcgccgtcctgacccacaacgggaagcgcctcgagccgaactgggcgagcgtgaagaaggacctgatctcctacggcgggggctggcggctgagcgcccagtggcagaagggggaggaggtgcaggtcatcgccgtggagcccggcaagaaccccaagaacttccagaccatgcccggcaccttccagacgaccaccggggagatcggcgccatcgccctcgacttcaagccggggaccagcggctcccccatcatcaaccgcgagggcaaggtggtcgggctgtacggcaacggggtggtgacgaagaacggcgggtacgtcagcggcatcgcgcagacctccgccgagcccgacggcccgacccccgagctggaggaggagatgttccggaagcgcaacctgaccatcatggacctccaccccgggagcggcaagacgcggaagtacctgcccgccatcgtgcgcgaggccatcaagcggcgcctgcggaccctcatcctggccccgacccgcgtggtcgcggccgagatggaggaggccctgaaggggctccccatccggtaccagaccacggccaccaagtccgagcacaccggccgcgagatcgtggacctgatgtgccacgccaccttcacgatgcggctgctcagccccgtgcgcgtccccaactacaacctgatcatcatggacgaggcgcacttcaccgacccggcctccatcgccgcccgggggtacatcagcacccgcgtgggcatgggcgaggcggccgccatcttcatgaccgccacgccgcccgggaccgccgacgcgttcccccagtccaacgccccgatccaggacgaggagcgcgacatccccgagcggagctggaactccggcaacgagtggatcaccgacttcgccgggaagaccgtgtggttcgtccccagcatcaaggccggcaacgacatcgccaactgcctgcgcaagaacgggaagaaggtgatccagctctcccggaagacgttcgacaccgagtaccagaagaccaagctgaacgactgggacttcgtggtcaccacggacatcagcgagatgggcgcgaacttcaaggccgaccgcgtgatcgacccccggcgctgcctgaagccggtgatcctcaccgacggccccgagcgggtcatcctggccgggcccatgcccgtgaccgccgcctccgcggcccagcgccggggccgcgtggggcggaacccgcagaaggagaacgaccagtacatcttcaccggccagcccctgaacaacgacgaggaccacgcccactggaccgaggccaagatgctcctggacaacatcaacacgcccgaggggatcatccccgcgctgttcgagccggagcgcgagaagtccgccgccatcgacggcgagtaccggctcaagggcgagagccgcaagaccttcgtcgagctgatgcggcgcggggacctgcccgtgtggctcgcccacaaggtggccagcgagggcatcaagtacaccgaccggaagtggtgcttcgacgggcagcgcaacaaccagatcctggaggagaacatggacgtcgagatctggaccaaggagggcgagaagaagaagctgcggccccgctggctcgacgcgcgcacgtactccgaccccctggccctgaaggagttcaaggacttcgccgccggccggaagtccatcgccctcgacctggtgaccgagatcgggcgcgtcccgagccacctggcgcaccggacccgcaacgccctcgacaacctggtgatgctgcacacctccgagcacggcgggcgggcctaccgccacgccgtggaggagctccccgagacgatggagaccctgctgctcctgggcctgatgatcctcctgaccgggggcgccatgctgttcctcatcagcggcaaggggatcggcaagacctccatcgggctgatctgcgtcatcgcgagctccggcatgctgtggatggccgacgtgcccctccagtggatcgccagcgccatcgtgctggagttcttcatgatggtcctgctcatcccggagcccgagaagcagcggacgccccaggacaaccagctggcctacgtggtgatcgggatcctgaccctcgcggccatcatcgccgccaacgagatgggcctgctggagaccaccaagcgcgacctcggcatgtccaaggagcccggggtcgtgagcccgacgtcctacctggacgtggacctgcaccccgcgagcgcctggaccctctacgccgtcgccaccaccgtgatcacgcccatgctgcggcacaccatcgagaactccaccgccaacgtgagcctggcggccatcgccaaccaggccgtcgtgctcatgggcctggacaaggggtggcccatctccaagatggacctgggcgtgccgctcctggccctggggtgctacagccaggtcaaccccctcaccctgacggcggccgtgctgctcctgatcacccactacgccatcatcggccccggcctgcaggccaaggccacccgcgaggcgcagaagcggaccgccgccgggatcatgaagaaccccacggtggacggcatcatgaccatcgacctcgacccggtcatctacgactccaagttcgagaagcagctgggccaggtgatgctgctcgtgctgtgcgccgtccagctgctcctgatgcgcaccagctgggcgctgtgcgaggccctcaccctggccacgggccccatcaccaccctgtgggagggctcccccgggaagttctggaacaccacgatcgccgtgagcatggccaacatcttccggggctcctacctcgcgggggccggcctggccttcagcatcatgaagtccgtggggaccggcaagcgcggcaccgggtcccagggcgagaccctgggggagaagtggaagaagaagctcaaccagctgagccggaaggagttcgacctgtacaagaagtccggcatcaccgaggtcgaccgcacggaggccaaggaggggctcaagcggggcgagaccacccgccacgccgtgagccggggctccgcgaagctgcagtggttcgtggagcgcaacatggtcatccccgaggggcgggtgatcgacctgggctgcgggcgcggcgggtggagctactactgcgccggcctcaagaaggtgaccgaggtccgcggctacacgaagggcgggccggggcacgaggagcccgtgcccatgtccacctacggctggaacatcgtgaagctgatgagcgggaaggacgtcttctacctgcccccggagaagtgcgacaccctcctgtgcgacatcggcgagtccagcccctcccccaccgtggaggagagccggacgatccgcgtgctgaagatggtcgagccctggctgaagaacaaccagttctgcatcaaggtgctcaacccgtacatgcccaccgtgatcgagcacctggagcggctgcagcgcaagcacggcgggatgctcgtccggaaccccctgtcccgcaacagcacccacgagatgtactggatctccaacggcaccgggaacatcgtgagctccgtgaacatggtcagccggctgctcctgaaccgcttcacgatgacccaccggcgccccaccatcgagcgggacgtggacctgggcgccggcacccgccacgtgaacgccgagccggagatccccaacatggacgtcatcggggagcggatcaagcgcatcaaggaggagcacaactccacgtggcactacgacgacgagaacccctacaagacctgggcctaccacggcagctacgaggtgaaggcgaccgggagcgcctccagcatgatcaacggcgtggtcaagctcctgaccaagccgtgggacgtggtccccatggtgacgcagatggccatgaccgacaccacccccttcgggcagcagcgggtgttcaaggagaaggtcgacacgcgcacgccccggccgatgcccggcacccgcaaggtgatggagatcaccgccgagtggctgtggcggacgctcggccgcaacaagcgcccccggctgtgcacccgcgaggagttcaccaagaaggtgcggaccaacgcggccatgggggccgtcttcacggaggagaaccagtgggactccgccaaggccgcggtggaggacgaggagttctggaagctggtggaccgcgagcgggagctccacaagctgggcaagtgcgggagctgcgtctacaacatgatgggcaagcgcgagaagaagctgggggagttcggcaaggccaagggctcccgggccatctggtacatgtggctcggggcccgctacctggagttcgaggccctgggcttcctcaacgaggaccactggttcagccgggagaactcctacagcggggtggagggcgaggggctgcacaagctgggctacatcctccgcgacatctccaagatccccggcggggcgatgtacgccgacgacaccgccggctgggacacccggatcaccgaggacgacctgcacaacgaggagaagatcacgcagcagatggacccggagcaccgccagctggccaacgccatcttcaagctcacctaccagaacaaggtggtcaaggtgcagcggcccacccccaccgggaccgtgatggacatcatcagccgcaaggaccagcggggctccggccaggtcgggacgtacggcctgaacaccttcaccaacatggaggcgcagctggtgcgccagatggagggggagggcgtgctcagcaaggccgacctggagaacccccacctcctcgagaagaagatcacccagtggctggagacgaagggggtcgagcggctgaagcgcatggccatctccggcgacgactgcgtggtgaagccgatcgacgaccggttcgccaacgccctcctggcgctgaacgacatgggcaaggtccgcaaggacatcccccagtggcagcccagcaaggggtggcacgactggcagcaggtccccttctgctcccaccacttccacgagctcatcatgaaggacggccggaagctggtggtcccgtgccgcccccaggacgagctgatcgggcgcgcccggatcagccagggcgccgggtggtccctccgcgagaccgcctgcctgggcaaggcgtacgcccagatgtggagcctgatgtacttccaccggcgcgacctccggctggcctccaacgccatctgcagcgccgtgcccgtgcactgggtccccaccagccgcaccacgtggtccatccacgcgcaccaccagtggatgaccaccgaggacatgctgaccgtgtggaaccgggtgtggatcgaggacaacccgtggatggaggacaagacgcccgtcaccacctgggagaacgtgccctacctcggcaagcgcgaggaccagtggtgcgggagcctgatcggcctgacctcccgggccacgtgggcccagaacatccccaccgccatccagcaggtccgcagcctcatcgggaacgaggagttcctggactacatgccgtccatgaagcggttccgcaaggaggaggagagcgagggcgccatctggtga

SEQ ID NO: 9986 - RNA, 9873 nt, synthetic construct
  misc_feature 1..9873: note = derived and/or modified CDS sequence (opt1) from DENV-3__FJ882571__SS-prME
  source 1..9873: mol_type = other RNA
accagcctctgcctcatgatgatcctgcccgccgccctggcgttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgacgtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgctgttcaccttcgtgctcctgctgtccggccagatcacctggcgcgacatggcccacacgctcatcatgatcggcagcaacgcctccgaccggatggggatgggcgtcacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcgtgagcctgacctgctccaacaccatcctgaccctcacggtcgcctggcgcaccgcgaccctgatcctggccggggtgagcctcctgccggtctgccagtccagctccatgcggaagaccgactggctgcccatgacggtggccgccatgggcgtgccgcccctcccgctgttcatcttcagcctgaaggacaccctcaagcgccgctcctggcccctgaacgagggggtcatggccgtgggcctggtgagcatcctcgcgtccagcctgctgcggaacgacgtccccatggccggccccctcgtggccgggggcctgctgatcgcctgctacgtgatcaccgggacctccgccgacctcatcgtcgagaaggcggccgacgtgacgtgggaggaggaggccgagcagaccggcgtgagccacaacctgatgatcaccgtcgacgacgacgggaccatgcgcatcaaggacgacgagaccgagaacatcctgacggtgctcctgaagaccgccctgctcatcgtgtccggcatcttcccgtacagcatccccgccaccctgctggtctggcacacctggcagaagcagacgcagcggtccggcgtgctctgggacgtgcccagcccgcccgagacccagaaggcggagctggaggagggggtctaccgcatcaagcagcagggcatcctggggaagacccaggtgggcgtgggggtccagaaggagggcgtgttccacaccatgtggcacgtgacgcggggcgccgtcctcacccacaacgggaagcgcctggagcccaactgggcctccgtgaagaaggacctgatcagctacggcgggggctggcggctgtccgcccagtggcagaagggggaggaggtgcaggtcatcgcggtggagcccggcaagaaccccaagaacttccagaccatgcccggcaccttccagacgaccaccggggagatcggcgccatcgccctcgacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggcgatcgtgcgggaggccatcaagcgccggctccgcaccctgatcctggcccccacccgggtggtcgccgccgagatggaggaggcgctcaaggggctgcccatccgctaccagaccacggccaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgcggcccgcgggtacatcagcacccgggtgggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtccccagcatcaaggccggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggcggggcccatgccggtgaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtcgagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgcggccggccgcaagagcatcgccctggacctggtgaccgagatcgggcgggtcccctcccacctcgcccaccgcacccggaacgccctggacaacctggtgatgctccacaccagcgagcacggcgggcgcgcgtaccggcacgccgtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgcgagcgccatcgtgctggagttcttcatgatggtgctcctgatccccgagcccgagaagcagcgcacgccccaggacaaccagctggcctacgtcgtgatcgggatcctcaccctggccgccatcatcgcggccaacgagatgggcctgctcgagaccaccaagcgggacctgggcatgtccaaggagccgggggtggtcagccccacgtcctacctggacgtggacctccaccccgccagcgcctggaccctgtacgcggtggccaccaccgtcatcacgcccatgctgcgccacaccatcgagaactccaccgccaacgtgagcctcgccgccatcgcgaaccaggccgtggtcctgatgggcctggacaaggggtggccgatctccaagatggacctcggcgtgcccctgctggccctcgggtgctacagccaggtgaaccccctgaccctgacggccgccgtcctcctgctgatcacccactacgcgatcatcggccccggcctccaggccaaggccacccgggaggcccagaagcgcaccgccgcggggatcatgaagaacccgacggtggacggcatcatgaccatcgacctggaccccgtgatctacgactccaagttcgagaagcagctggggcaggtcatgctcctggtgctgtgcgccgtgcagctcctgctgatgcggaccagctgggccctctgcgaggccctgaccctggcgacgggccccatcaccaccctctgggagggctcccccgggaagttctggaacaccacgatcgccgtcagcatggccaacatcttccgcggctcctacctggccggggccggcctggcgttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtggaccggacggaggccaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctgccgcccgagaagtgcgacaccctcctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcagctccgtgaacatggtgagccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaactccacgtggcactacgacgacgagaacccgtacaagacctgggcctaccacggcagctacgaggtcaaggccaccgggtccgccagcagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgccccatgcccggcacccggaaggtcatgggcatcaccgccgagtggctctggcgcacgctggggcggaacaagcgcccccggctgtgcacccgcgaggagttcaccaagaaggtgcgcaccaacgccgccatgggcgcggtgttcacggaggagaaccagtgggactccgccaaggccgccgtcgaggacgaggagttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgacaactcctacagcggcgtcgagggggagggcctgcacaagctcggctacatcctgcgggacatctccaagatccccggcggggccatgtacgccgacgacaccgcggggtgggacacccgcatcaccgaggacgacctgcacaacgaggagaagatcacgcagcagatggaccccgagcaccggcagctcgccaacgccatcttcaagctgacctaccagaacaaggtggtgaaggtccagcgccccacccccaccgggaccgtgatggacatcatcagccggaaggaccagcgcggctccggccaggtgggcacgtacgggctgaacaccttcaccaacatggaggtccagctcgtgcggcagatggagggcgagggggtgctgagcaaggccgacctggagaacccgcacctccccgagaagaagatcacccagtggctggagacgaagggcgtcgagcgcctgaagcggatggccatctccggcgacgactgcgtggtgaagcccatcgacgaccgcttcgcgaacgccctcctggccctgaacgacatggggaaggtccggaaggacatcccccagtggcagccgagcaagggcatgcacgactggcagcaggtccccttctgctcccaccacttccacgagctcatcatgaaggacgggcgcaagctggtggtcccctgccggccccaggacgagctgatcggccgcgcccggatcagccagggggccggctggtccctccgcgagaccgcgtgcctgggcaaggcctacgcccagatgtggagcctgatgtacttccaccgccgggacctccgcctggcctccaacgcgatctgcagcgccgtgccggtgcactgggtccccacctcccggaccacgtggagcatccacgcccaccaccagtggatgaccaccgaggacatgctggccgtgtggaaccgcgtgtggatcgaggacaacccctggatggaggacaagacccccgtcacgacctgggaggacgtgccgtacctcgggaagcgggaggaccagtggtgcggcagcctgatcgggctgacctcccgcgccacctgggcgcagaacatcctcacggccatccagcaggtccggagcctgatcggcaacgaggagttcctggactacatgccctccatgaagcgcttccggaaggaggaggagagcgagggggccatctggtga

SEQ ID NO: 9987 - RNA, 9873 nt, synthetic construct
  misc_feature 1..9873: note = derived and/or modified CDS sequence (opt1) from DENV-3__FJ882572__SS-prME
  source 1..9873: mol_type = other RNA
accagcctgtgcctcatgatgatcctgcccgccgccctggcgttccacctcaccagccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacctgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagtacgagaacctcaagtacaccgtgatcatcacggtccacaccggggaccagcaccaggtgggcaacgagacccagggggtcaccgccgagatcacgccccaggcctccaccaccgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaaccgcaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgcgccctgcaagatccccttcagcaccgaggacgggcagggcaaggcccacaacggccgcctgatcacggccaaccccgtcgtgaccaagaaggaggagcccgtgaacatcgaggccgagcccccgttcggggagtccaacatcgtcatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtgggcggggtgctcaactccctgggcaagatggtccaccagatcttcgggagcgcctacacggccctgttctccggcgtgagctgggtgatgaagatcggcatcggggtcctcctgacctggatcggcctgaactccaagaacaccagcatgtccttcagctgcatcgccatcgggatcatcaccctctacctgggcgccgtggtgcaggcggacacggggtgcgtcatcaactggaagggcaaggagctgaagtgcggctccgggatcttcgtgaccaacgaggtgcacacctggaccgagcagtacaagttccaggccgacagccccaagcgcctcgccacggccatcgccggcgcgtgggagaacggggtctgcggcatccgctccaccacccggatggagaacctgctgtggaagcagatcgccaacgagctcaactacatcctgtgggagaacaacatcaagctgaccgtggtggtcggggacacgatcggcgtgctcgagcagggcaagcgcaccctgacgccccagcccatggagctgaagtacagctggaagacctgggggaaggccaagatcgtgacggccgagatccagaactccagcttcatcatcgacggcccgaacacccccgagtgcccctccgcgagccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagtcccagaagaacgggagctggaagctggagaaggcctccttcatcgaggtcaagacgtgcacctggcccaagagccacaccctgtggtccaacggcgtgctcgagagcgacatgatcatcccgaagtccctggccgggcccatcagccagcacaactaccggcccggctaccacacccagacggccgggccgtggcacctgggcaagctcgagctggacttcaactactgcgagggcaccaccgtggtcatcaccgagaactgcgggacgcgcggcccctccctgcggaccaccaccgtgagcgggaagctcatccacgagtggtgctgccgctcctgcacgctgccgcccctgcggtacatgggcgaggacgggtgctggtacggcatggagatccgcccgatcagcgagaaggaggagaacatggtgaagtccctcgccagcgcgggctccgggaaggtcgacaacttcaccatgggcgtgctgtgcctggccatcctcttcgaggaggtgatgcgggggaagttcggcaagaagcacatgatcgccggggtcttcttcaccttcgtgctgctgctcagcggccagatcacctggcgcgacatggcccacacgctgatcatgatcggctccaacgccagcgaccggatggggatgggcgtgacctacctggcgctcatcgccaccttcaagatccagcccttcctggccctggggttcttcctccgcaagctgaccagccgggagaacctgctcctgggcgtcggcctggccatggcgacgaccctccagctgcccgaggacatcgagcagatggccaacgggatcgccctgggcctcatggccctgaagctgatcacccagttcgagacctaccagctctggacggccctgatctccctgacctgcagcaacaccatgttcaccctcacggtggcgtggcgcaccgccaccctgatcctggccggggtgtccctcctgcccgtctgccagagctccagcatgcggaagaccgactggctgccgatgacggtggccgccatgggcgtgccgcccctgcccctgttcatcttctccctgaaggacaccctcaagcgccgcagctggccgctgaacgagggggtgatggcggtgggcctggtctccatcctcgccagctccctgctgcggaacgacgtgcccatggccggccccctcgtggccgggggcatgctgatcgcctgctacgtcatcaccgggaccagcgcggacctgacggtggagaaggccgccgacgtgacctgggaggaggaggccgagcagaccggcgtctcccacaacctcatgatcaccgtggacgacgacgggaccatgcgcatcaaggacgacgagacggagaacatcctgaccgtgctgctcaagaccgccctgctgatcgtcagcggcatcttcccctactccatcccggcgaccctcctggtgtggcacacgtggcagaagcagacccagcggagcggcgtgctgtgggacgtccccagcccgcccgagacccagaaggccgagctcgaggagggggtgtaccgcatcaagcagcagggcatcctggggaagacccaggtgggcgtcggggtgcagaaggagggcgtgttccacacgatgtggcacgtcacccggggcgccgtgctgacccacaacgggaagcgcctcgagccgaactgggccagcgtgaagaaggacctgatctcctacggcgggggctggcggctgagcgcgcagtggcagaagggggaggaggtccaggtgatcgccgtggagcccggcaagaaccccaagaacttccagaccatgcccggcacgttccagaccaccaccggggagatcggcgccatcgccctcgacttcaagccggggacgagcggctcccccatcatcaaccgcgagggcaaggtcgtggggctgtacggcaacggggtggtcaccaagaacggcgggtacgtgagcggcatcgcccagacctccgcggagcccgacggcccgacccccgagctggaggaggagatgttccggaagcgcaacctgacgatcatggacctccaccccgggagcggcaagacccggaagtacctgcccgccatcgtgcgcgaggccatcaagcggcgcctgcggaccctcatcctggccccgacccgcgtcgtggccgcggagatggaggaggccctgaaggggctccccatccggtaccagacgaccgccaccaagtccgagcacaccggccgcgagatcgtggacctgatgtgccacgccacgttcaccatgcggctgctcagccccgtccgcgtgcccaactacaacctgatcatcatggacgaggcccacttcaccgacccggcgtccatcgccgcccgggggtacatcagcacccgcgtgggcatgggcgaggccgcggccatcttcatgacggccacgccgcccgggaccgccgacgccttcccccagtccaacgcgccgatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtgatccagctctcccggaagaccttcgacaccgagtaccagaagaccaagctgaacgactgggacttcgtcgtgacgaccgacatcagcgagatgggcgccaacttcaaggcggaccgcgtgatcgacccccggcgctgcctgaagccggtcatcctcaccgacggccccgagcgggtgatcctggccgggcccatgcccgtgaccgccgcctccgccgcgcagcgccggggccgcgtcgggcggaacccgcagaaggagaacgaccagtacatcttcaccggccagcccctgaacaacgacgaggaccacgcccactggacggaggccaagatgctcctggacaacatcaacacccccgaggggatcatccccgccctgttcgagccggagcgcgagaagtccgcggccatcgacggcgagtaccggctcaagggcgagagccgcaagaccttcgtggagctgatgcggcgcggggacctgcccgtgtggctcgcccacaaggtcgccagcgagggcatcaagtacaccgaccggaagtggtgcttcgacgggcagcgcaacaaccagatcctggaggagaacatggacgtggagatctggacgaaggagggcgagaagaagaagctgcggccccgctggctcgacgcccgcacctactccgaccccctggcgctgaaggagttcaaggacttcgccgccggccggaagtccatcgccctcgacctggtcaccgagatcgggcgcgtgccgagccacctggcccaccggacccgcaacgcgctcgacaacctggtgatgctgcacacgtccgagcacggcgggcgggcctaccgccacgccgtcgaggagctccccgagaccatggagaccctgctgctcctgggcctgatgatcctcctgaccgggggcgccatgctgttcctcatcagcggcaaggggatcggcaagacgtccatcgggctgatctgcgtgatcgccagctccggcatgctgtggatggcggacgtgcccctccagtggatcgccagcgccatcgtcctggagttcttcatgatggtgctgctcatcccggagcccgagaagcagcggacgccccaggacaaccagctggcctacgtggtcatcgggatcctgaccctcgccgcgatcatcgccgccaacgagatgggcctgctggagaccacgaagcgcgacctcggcatgtccaaggagcccggggtggtgagcccgacctcctacctggacgtcgacctgcaccccgccagcgcgtggaccctctacgccgtggccaccacggtgatcacccccatgctgcggcacaccatcgagaactccaccgccaacgtcagcctggccgcgatcgccaaccaggccgtggtgctcatgggcctggacaaggggtggcccatctccaagatggacctgggcgtcccgctcctggccctggggtgctacagccaggtgaaccccctcacgctgaccgccgcggtgctgctcctgatcacccactacgccatcatcggccccggcctgcaggccaaggccacccgcgaggcccagaagcggacggcggccgggatcatgaagaaccccaccgtcgacggcatcatgaccatcgacctcgacccggtgatctacgactccaagttcgagaagcagctgggccaggtgatgctgctcgtcctgtgcgccgtgcagctgctcctgatgcgcaccagctgggccctgtgcgaggcgctcacgctggccaccggccccatcaccaccctgtgggagggctcccccgggaagttctggaacacgaccatcgccgtgagcatggccaacatcttccggggctcctacctcgccggggcgggcctggccttcagcatcatgaagtccgtcgggaccggcaagcgcggcaccgggtcccagggcgagaccctgggggagaagtggaagaagaagctcaaccagctgagccggaaggagttcgacctgtacaagaagtccggcatcacggaggtggaccgcaccgaggccaaggaggggctcaagcggggcgagaccacccaccacgccgtgagccgcggctccgccaagctgcagtggttcgtcgagcggaacatggtgatccccgaggggcgcgtgatcgacctgggctgcgggcggggcgggtggagctactactgcgcgggcctcaagaaggtcacggaggtgcgcggctacaccaagggcgggccggggcacgaggagcccgtgcccatgtccacctacggctggaacatcgtcaagctgatgagcgggaaggacgtgttctacctgcccccggagaagtgcgacaccctcctgtgcgacatcggcgagtccagcccctcccccacggtggaggagagccgcaccatccgggtcctgaagatggtggagccctggctgaagaacaaccagttctgcatcaaggtgctcaacccgtacatgcccaccgtcatcgagcacctggagcgcctgcagcggaagcacggcgggatgctcgtgcgcaaccccctgtcccggaacagcacccacgagatgtactggatctccaacggcacggggaacatcgtgagctccgtcaacatggtgagccgcctgctcctgaaccggttcaccatgacccaccgccggcccaccatcgagcgcgacgtggacctgggcgccggcacgcggcacgtcaacgccgagccggagatccccaacatggacgtgatcggggagcgcatcaagcggatcaaggaggagcacaactccacctggcactacgacgacgagaacccctacaagacctgggcctaccacggcagctacgaggtgaaggccaccgggagcgcgtccagcatgatcaacggcgtcgtgaagctcctgacgaagccgtgggacgtcgtgcccatggtgacccagatggccatgaccgacaccacgcccttcgggcagcagcgcgtcttcaaggagaaggtggacacccggacgccccgcccgatgcccggcacccggaaggtgatggagatcacggccgagtggctgtggcgcaccctcggccggaacaagcgcccccgcctgtgcacccgggaggagttcaccaagaaggtccgcacgaacgccgcgatgggggccgtgttcaccgaggagaaccagtgggactccgccaaggccgccgtggaggacgaggagttctggaagctggtcgaccgggagcgcgagctccacaagctgggcaagtgcgggagctgcgtgtacaacatgatgggcaagcgggagaagaagctgggggagttcggcaaggcgaagggctcccgcgccatctggtacatgtggctcggggcccggtacctggagttcgaggccctgggcttcctcaacgaggaccactggttcagccgcgagaactcctacagcggggtggagggcgaggggctgcacaagctgggctacatcctccgggacatctccaagatccccggcggggccatgtacgcggacgacaccgccggctgggacacccgcatcacggaggacgacctgcacaacgaggagaagatcacccagcagatggacccggagcaccggcagctggccaacgccatcttcaagctcacctaccagaacaaggtcgtgaaggtgcagcgccccacccccaccgggacggtcatggacatcatcagccggaaggaccagcgcggctccggccaggtggggacctacggcctgaacaccttcaccaacatggaggcccagctggtgcggcagatggagggggagggcgtcctcagcaaggcggacctggagaacccccacctcctcgagaagaagatcacgcagtggctggagaccaagggggtggagcgcctgaagcggatggccatctccggcgacgactgcgtggtcaagccgatcgacgaccgcttcgccaacgccctcctggccctgaacgacatgggcaaggtgcggaaggacatcccccagtggcagcccagcaaggggtggcacgactggcagcaggtccccttctgctcccaccacttccacgagctcatcatgaaggacggccgcaagctggtcgtgccgtgccggccccaggacgagctgatcgggcgcgcgcgcatcagccagggcgccgggtggtccctccgggagaccgcctgcctgggcaaggcctacgcgcagatgtggagcctgatgtacttccaccgccgggacctccgcctggcctccaacgccatctgcagcgccgtgcccgtccactgggtgcccaccagccggacgacctggtccatccacgcccaccaccagtggatgaccaccgaggacatgctgacggtgtggaaccgcgtctggatcgaggacaacccgtggatggaggacaagacccccgtgaccacctgggagaacgtgccctacctcggcaagcgggaggaccagtggtgcgggagcctgatcggcctgacgtcccgcgcgacctgggcccagaacatccccaccgccatccagcaggtccggagcctcatcgggaacgaggagttcctggactacatgccgtccatgaagcgcttccggaaggaggaggagagcgagggcgccatctggtga

SEQ ID NO: 9988 - RNA, 9873 nt, synthetic construct
  misc_feature 1..9873: note = derived and/or modified CDS sequence (opt1) from DENV-3__FJ882573__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctgggccagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacccccatgtccttcagctgcatcgccatcgggatcatcaccctctacctgggcgcggtggtgcaggccgacatggggtgcgtcatcaactggaagggcaaggagctgaagtgcggctccgggatcttcgtgaccaacgaggtgcacacgtggaccgagcagtacaagttccaggccgacagccccaagcgcctcgccaccgccatcgcgggcgcctgggagaacggggtctgcggcatccgctccaccacgcggatggagaacctgctgtggaagcagatcgccaacgagctcaactacatcctgtgggagaacaacatcaagctgaccgtggtggtcggggacaccaccggcgtgctcgagcagggcaagcgcacgctgaccccgcagcccatggagctgaagtacagctggaagacctgggggaaggccaagatcgtgaccgcggagacgcagaactccagcttcatcatcgacggccccaacacccccgagtgcccgtccgccagccgggcctggaacgtctgggaggtggaggactacgggttcggcgtgttcaccaccaacatctggctcaagctgcgcgaggtctacacccagctgtgcgaccaccggctcatgtccgccgccgtgaaggacgagcgcgcggtgcacgccgacatgggctactggatcgagagccagaagaacgggagctggaagctggagaaggcctccctgatcgaggtcaagacgtgcacctggcccaagagccacaccctctggtccaacggcgtgctggagagcgacatgatcatccccaagtccctggccgggccgatcagccagcacaactaccggcccggctaccacacccagacggccgggccctggcacctcggcaagctggagctggacttcaactactgcgagggcaccaccgtggtcatcaccgagaactgcgggacgcgcggcccctccctccggaccaccaccgtgagcgggaagctgatccacgagtggtgctgccgctcctgcacgctgccgcccctccggtacatgggcgaggacgggtgctggtacggcatggagatccgccccatcagcgagaaggaggagaacatggtgaagtccctggtcagcgcgggctccgggaaggtggacaacttcaccatgggcgtgctgtgcctcgccatcctgttcgaggaggtcatgcgggggaagttcggcaagaagcacatgatcgccggggtgttcttcaccttcgtgctgctcctgagcggccagatcacctggcgcgacatggcccacacgctgatcatgatcggctccaacgccagcgaccggatggggatgggcgtcacctacctcgcgctgatcgccaccttcaagatccagcccttcctggccctcgggttcttcctgcgcaagctgacctcccgggagaacctcctgctgggcgtgggcctcgccatggcgacgaccctgcagctgccggaggacatcgagcagatggccaacgggatcgccctcggcctgatggccctgaagctcatcacccagttcgagacctaccagctgtggacggccctggtgagcctgacctgcagcaacaccatcttcaccctgacggtcgcgtggcgcaccgccaccctgatcctcgccggggtgtccctgctgcccgtctgccagagctccagcatgcggaagaccgactggctccccatgacggtggccgccatgggcgtgcccccgctgcccctgttcatcttctccctcaaggacaccctgaagcgccgcagctggcccctgaacgagggggtcatggcggtgggcctcgtgtccatcctggccagctccctgctccggaacgacgtccccatggccggcccgctggtggccgggggcctgctcatcgcctgctacgtgatcaccgggaccagcgcggacctgacggtcgagaaggccgccgacgtgacctgggaggaggaggccgagcagaccggcgtgtcccacaacctgatgatcaccgtcgacgacgacgggaccatgcgcatcaaggacgacgagacggagaacatcctcaccgtgctgctgaagaccgccctcctgatcgtgagcggcatcttcccctactccatccccgcgaccctgctcgtctggcacacgtggcagaagcagacccagcggagcggcgtgctgtgggacgtgccctccccgcccgagacccagaaggccgagctggaggagggggtctaccgcatcaagcagcagggcatcctcgggaagacccaggtgggcgtgggggtccagaaggagggcgtgttccacacgatgtggcacgtgacccggggcgccgtcctgacccacaacgggaagcgcctggagcccaactgggccagcgtgaagaaggacctcatctcctacggcgggggctggcggctgagcgcgcagtggcagaagggggaggaggtgcaggtcatcgccgtggagcccggcaagaacccgaagaacttccagaccatgcccggcacgttccagaccaccaccggggagatcggcgccatcgccctggacttcaagcccgggacgtccggcagcccgatcatcaaccgcgagggcaaggtggtcgggctgtacggcaacggggtggtgaccaagaacggcgggtacgtcagcggcatcgcccagaccaacgcggagcccgacggccccacccccgagctcgaggaggagatgttcaagaagcggaacctgacgatcatggacctgcacccggggtccggcaagacccgcaagtacctccccgccatcgtgcgggaggccatcaagcgccggctgcgcaccctgatcctcgcccccacccgggtggtcgccgcggagatggaggaggccctgaaggggctgcccatccgctaccagacgaccgccaccaagagcgagcacaccggccgggagatcgtggacctcatgtgccacgccacgttcaccatgcgcctgctgtccccggtgcgggtccccaactacaacctcatcatcatggacgaggcccacttcaccgaccccgcgagcatcgccgcccgcgggtacatctccacccgggtgggcatgggcgaggccgcggccatcttcatgacggccacgccgcccgggaccgccgacgccttcccccagagcaacgcgcccatccaggacgaggagcgcgacatccccgagcgctcctggaacagcggcaacgagtggatcaccgacttcgccgggaagacggtgtggttcgtcccctccatcaaggccggcaacgacatcgccaactgcctgcggaagaacgggaagaaggtgatccagctgagccgcaagaccttcgacaccgagtaccagaagaccaagctcaacgactgggacttcgtggtcacgaccgacatctccgagatgggcgccaacttcaaggcggaccgggtgatcgacccccgccggtgcctgaagcccgtgatcctgaccgacggccccgagcgcgtcatcctcgccgggccgatgcccgtgaccgccgccagcgccgcgcagcggcgcggccgggtggggcgcaacccccagaaggagaacgaccagtacatcttcaccggccagcccctgaacaacgacgaggaccacgcccactggacggaggccaagatgctgctcgacaacatcaacaccccggaggggatcatccccgccctgttcgagcccgagcgggagaagtccgcggccatcgacggcgagtaccgcctgaagggcgagagccggaagaccttcgtcgagctcatgcgccgcggggacctgcccgtgtggctggcccacaaggtcgcctccgagggcatcaagtacaccgaccgcaagtggtgcttcgacgggcagcggaacaaccagatcctcgaggagaacatggacgtggagatctggacgaaggagggcgagaagaagaagctgcgcccgcggtggctggacgcccgcacctacagcgaccccctcgcgctgaaggagttcaaggacttcgccgccggccgcaagtccatcgccctggacctcgtgaccgagatcgggcgggtccccagccacctggcccaccgcacccggaacgcgctggacaacctcgtgatgctgcacacgtccgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacgagcatcgggctcatctgcgtcatcgcctccagcggcatgctgtggatggcggaggtgcccctgcagtggatcgcctccgccatcgtgctcgagttcttcatgatggtcctgctgatccccgagcccgagaagcagcgcaccccgcaggacaaccagctcgcctacgtggtgatcgggatcctgaccctggccgcgatgatcgccgccaacgagatgggcctcctggagaccacgaagcgggacctgggcatgagcaaggagcccggggtcgtgtcccccaccagctacctcgacgtggacctgcaccccgcctccgcgtggaccctgtacgccgtcgccaccacggtgatcaccccgatgctccgccacaccatcgagaacagcaccgccaacgtgtccctggccgcgatcgccaaccaggccgtcgtgctgatgggcctcgacaaggggtggcccatcagcaagatggacctgggcgtgcccctgctcgccctggggtgctactcccaggtcaaccccctgacgctcaccgccgcggtgctgctgctcatcacccactacgccatcatcggcccgggcctgcaggccaaggccacccgggaggcccagaagcgcacggcggccgggatcatgaagaaccccaccgtggacggcatcatgaccatcgacctggaccccgtcatctacgacagcaagttcgagaagcagctcggccaggtgatgctgctggtgctctgcgccgtccagctgctgctcatgcggacctcctgggccctgtgcgaggcgctgacgctcgccaccggccccatcaccaccctgtgggagggcagcccggggaagttctggaacacgaccatcgccgtgtccatggccaacatcttccgcggcagctacctggccggggcgggcctcgccttctccatcatgaagtccgtggggaccggcaagcggggcaccgggtcccagggcgagaccctgggggagaagtggaagaagaagctgaaccagctcagccgcaaggagttcgacctgtacaagaagtccggcatcacggaggtcgaccggaccgaggccaaggaggggctgaagcgcggcgagatcacccaccacgccgtgtcccggggcagcgccaagctccagtggttcgtggagcgcaacatggtcgtgcccgaggggcgggtgatcgacctgggctgcgggcgcggcgggtggtcctactactgcgcgggcctgaagaaggtcaccgaggtgcggggctacacgaagggcgggcccgggcacgaggagcccgtgccgatgagcacctacggctggaacatcgtcaagctcatgtccgggaaggacgtgttctacctgccgcccgagaagtgcgacaccctgctgtgcgacatcggcgagagctcccccagcccgaccgtggaggagtcccgcacgatccgcgtcctcaagatggtggagccctggctgaagaacaaccagttctgcatcaaggtgctgaacccctacatgcccaccgtcatcgagcacctcgagcggctgcagcgcaagcacggcgggatgctggtgcggaacccgctcagccgcaactccacccacgagatgtactggatcagcaacggcaccgggaacatcgtgtccagcgtcaacatggtgtcccggctgctgctcaaccgcttcacgatgacccaccggcgccccaccatcgagaaggacgtggacctgggcgccggcacccggcacgtcaacgccgagcccgagacgccgaacatggacgtgatcggggagcgcgtcaagcggatcaaggaggagcacaacagcacctggcactacgacgacgagaacccctacaagacctgggcctaccacggctcctacgaggtgaaggccaccgggagcgcgtccagcatgatcaacggcgtggtcaagctgctcacgaagccctgggacgtggtgcccatggtcacccagatggccatgaccgacaccacgccgttcgggcagcagcgcgtgttcaaggagaaggtggacacccggacgccccggcccatgcccggcacccggaaggtcatggagatcacggccgagtggctgtggcgcaccctgggccggaacaagcgcccgcggctctgcacccgcgaggagttcaccaagaaggtgcgcacgaacgccgcgatgggggccgtgttcaccgaggagaaccagtgggacagcgccaaggccgccgtcgaggacgaggagttctggaagctggtggaccgggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtcgagggcgaggggctccacaagctgggctacatcctgcgggacatcagcaagatccccggcggggccatgtacgcggacgacaccgccggctgggacacccgcatcacggaggacgacctccacaacgaggagaagatcatccagcagatggaccccgagcaccggcagctggccaacgccatcttcaagctgacctaccagaacaaggtggtgaaggtccagcgccccaccccgaccgggaccgtgatggacatcatctcccggaaggaccagcgcggcagcggccaggtggggacgtacggcctcaacaccttcaccaacatggaggcccagctggtccggcagatggagggggagggcgtgctgaccaaggcggacctcgagaacccccacctcctggagaagaagatcacgcagtggctcgaggccaagggggtggagcgcctgaagcggatggccatctccggcgacgactgcgtcgtgaagcccatcgacgaccgcttcgccaacgccctgctcgcgctgaacgacatgggcaaggtgcggaaggacatcccccagtggcagccgagcaaggggtggcacgactggcagcaggtccccttctgctcccaccacttccacgagctgatcatgaaggacggccgcaagctcgtggtgccctgccggccccaggacgagctgatcgggcgcgcccggatcagccagggcgccgggtggtccctgcgcgagaccgcctgcctcggcaaggcgtacgcccagatgtggagcctgatgtacttccaccgccgggacctgcgcctcgcctccaacgccatctgcagcgccgtcccggtgcactgggtgcccacctcccggaccacgtggagcatccacgcgcaccaccagtggatgaccaccgaggacatgctgaccgtctggaaccgcgtgtggatcgaggagaacccctggatggaggacaagacgcccgtgaccacctgggagaacgtcccgtacctgggcaagcgggaggaccagtggtgcgggtccctcatcggcctgaccagccgcgccacgtgggcccagaacatccccaccgccatccagcaggtccggagcctgatcgggaacgaggagttcctcgactacatgccctccatgaagcgcttccggaaggaggaggagagcgagggcgccatctggtga

SEQ ID NO: 9989 - RNA, 9873 nt, synthetic construct
  misc_feature 1..9873: note = derived and/or modified CDS sequence (opt1) from DENV-3__FJ898440__SS-prME
  source 1..9873: mol_type = other RNA
accagcctctgcctcatgatgatcctccccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcatcaccgaggcgatcctgcccgagtacggcaccctggggctcgagtgctccccgcgcaccggcctggacttcaacgagatggtgctgctcaccatgaagaacaaggcctggatggtgcaccggcagtggttcttcgacctgcccctgccctggacgagcggcgccaccaccgagacccccatctggaaccgcaaggagctcctggtcacgttcaagaacgcccacgccaagaagcaggaggtggtggtcctggggtcccaggagggcgcgatgcacaccgccctcaccggggccaccgagatccagaacagcggcgggacgtccatcttcgccggccacctgaagtgccggctgaagatggacaagctcgagctgaagggcatgagctacgccatgtgcaccaacaccttcgtgctgaagaaggaggtgtccgagacccagcacgggacgatcctcatcaaggtcgagtacaagggcgaggacgcgccgtgcaagatccccttcagcaccgaggacgggcagggcaaggcccacaacggccgcctgatcaccgccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccacggcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacctggatcggcctgaacagcaagaacacgtccatgagcttctcctgcatcgccatcgggatcatcaccctctacctgggcgccgtggtccaggcggacaccgggtgcgtgatcaactggaagggcaaggagctgaagtgcggcagcgggatcttcgtgaccaacgaggtccacacgtggaccgagcagtacaagttccaggccgactcccccaagcgcctcgccaccgccatcgccggcgcgtgggagaacggggtgtgcggcatccgcagcaccacgcggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacgtgggggaaggccaagatcgtcaccgccgagacccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgaccggatggggatgggcgtgacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatcttcaccctgaccgtcgcctggcgcaccgcgacgctgatcctcgccggggtgagcctgctgccggtctgccagtccagctccatgcggaagaccgactggctccccatgaccgtggccgccatgggcgtgcagcccctgcccctgttcatcttcagcctcaaggacaccctgaagcgccgctcctggccgctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacgtgacctgggaggaggaggccgagcagacgggcgtgagccacaacctgatgatcaccgtcgacgacgacgggaccatgcgcatcaaggacgacgagaccgagaacatcctcaccgtgctgctgaagacggccctcctgatcgtgtccggcatcttcccctacagcatcccggccaccctgctcgtctggcacacctggcagaagcagacccagcggtccggcgtgctgtgggacgtgccctccccgcccgagacgcagaaggcggagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagccgaactgggcctccgtgaagaaggacctgatcagctacggcgggggctggcggctctccgcccagtggcagaagggggaggaggtgcaggtcatcgcggtggagcccggcaagaaccccaagaacttccagaccatgcccggcaccttccagaccacgaccggggagatcggcgccatcgccctggacttcaagccggggaccagcggcagccccatcatcaaccgcgagggcaaggtggtcgggctgtacggcaacggggtggtgaccaagaacggcgggtacgtctccggcatcgcccagacgaacgccgagcccgacggcccgacccccgagctggaggaggagatgttcaagaagcggaacctcaccatcatggacctgcaccccgggagcggcaagacccgcaagtacctgcccgcgatcgtgcgggaggccatcaagcgccggctccgcacgctgatcctggccccgacccgggtggtcgccgccgagatggaggaggcgctcaaggggctgcccatccgctaccagaccaccgccacgaagtccgagcacaccggccgggagatcgtggacctgatgtgccacgccaccttcaccatgcgcctcctgagccccgtgcgggtccccaactacaacctgatcatcatggacgaggcccacttcacggacccggcctccatcgcggcccgcgggtacatcagcacccgggtgggcatgggcgaggccgccgcgatcttcatgaccgccacgccgcccgggacggccgacgccttcccccagtccaacgccccgatccaggacgaggagcgcgacatccccgagcgcagctggaactccggcaacgagtggatcaccgacttcgcggggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaaggccgaccgggtgatcgacccccgccggtgcctcaagccggtgatcctgacggacggccccgagcgcgtcatcctggcggggcccatgcccgtgaccgccgcctccgccgcccagcggcgcggccgggtggggcgcaacccgcagaaggagaacgaccagtacatcttcaccggccagcccctcaacaacgacgaggaccacgcgcactggaccgaggccaagatgctgctggacaacatcaacacccccgaggggatcatccccgccctcttcgagccggagcgggagaagtccgccgcgatcgacggcgagtaccgcctgaagggcgagtcccggaagacgttcgtcgagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgaccccctggccctcaaggagttcaaggacttcgcggccggccgcaagagcatcgccctggacctggtgacggagatcgggcgggtcccgtcccacctcgcccaccgcacccggaacgccctggacaacctggtgatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggccgagatccccctgcagtggatcgcgagcgccatcgtgctggagttcttcatgatggtgctcctgatcccggagcccgagaagcagcgcacgccccaggacaaccagctggcctacgtcgtgatcgggatcctcacgctggccgccatcatcgcggccaacgagatgggcctgctcgagaccaccaagaaggacctgggcatgtccaaggagcccggggtggtcagcccgacctcctacctggacgtggacctccaccccgccagcgcctggacgctgtacgcggtggccaccaccgtcatcacccccatgctgcggcacacgatcgagaactccaccgccaacgtgagcctcgccgccatcgcgaaccaggccgtggtcctgatgggcctggacaaggggtggcccatctccaagatggacctcggcgtgccgctgctggccctcgggtgctacagccaggtgaaccccctgaccctgaccgccgccgtcctcctgctgatcacgcactacgcgatcatcggccccggcctccaggccaaggccacccgcgaggcccagaagcggaccgccgcggggatcatgaagaaccccaccgtggacggcatcatgacgatcgacctggacccggtgatctacgactccaagttcgagaagcagctggggcaggtcatgctcctggtgctgtgcgccgtgcagctcctgctgatgcgcaccagctgggccctctgcgaggccctgaccctggcgaccggccccatcacgaccctctgggagggctcccccgggaagttctggaacaccaccatcgccgtcagcatggccaacatcttccggggctcctacctggccggggccggcctggcgttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagatcacgcaccacgccgtcagccgcggctccgccaagctgcagtggttcgtggagcggaacatggtgatccccgaggggcgcgtcatcgacctcggctgcgggcggggcgggtggagctactactgcgccggcctgaagaaggtgaccgaggtgcgcggctacaccaagggcgggccggggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccggaccatccgcgtgctgaagatggtggagccctggctcaagaacaaccagttctgcatcaaggtcctgaacccctacatgcccaccgtgatcgagcacctggagcgcctccagcggaagcacggcgggatgctggtgcgcaaccccctgtcccggaacagcacgcacgagatgtactggatctccaacggcaccgggaacatcgtcgcgagcgtgaacatggtgtcccgcctcctgctgaaccggttcaccatgacccaccgccggcccacgatcgagaaggacgtcgacctcggcgccggcacccgccacgtgaacgccgagccggagacccccaacatggacgtgatcggggagcggatcaagcgcatcaaggaggagcacaacagcacctggcactacgacgacgagaacccctacaagacgtgggcctaccacggctcctacgaggtcaaggccaccgggagcgcgtccagcatgatcaacggcgtggtcaagctgctgaccaagccgtgggacgtggtgcccatggtcacccagatggccatgacggacaccacccccttcgggcagcagcgggtgttcaaggagaaggtggacacccgcacgccccggagcatgccgggcacccgccgggtcatgggcatcaccgccgagtggctctggcgcaccctggggcggaacaagaagccccgcctgtgcacgcgggaggagttcaccaagaaggtgcgcaccaacgccgcgatgggcgccgtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgcggacgacacggccgggtgggacacccggatcaccgaggacgacctgcacaacgaggagaagatcacccagcagatgaaccccgagcaccgccagctcgccaacgccatcttcaagctgacgtaccagaacaaggtggtgaaggtccagcggccgacccccaccggcaccgtgatggacatcatcagccgcaaggaccagcggggctccggccaggtgggcacctacgggctgaacacgttcaccaacatggaggcccagctcatccgccagatggagggcgagggggtcctgagcaaggcggacctggagaacccccacctccccgagaagaagatcacccagtggctggagaccaagggcgtggagcggctgaagcgcatggccatctccggcgacgactgcgtggtcaagccgatcgacgaccggttcgccaacgccctcctggccctgaacgacatggggaaggtgcgcaaggacatcccccagtggcagcccagcaagggctggcacgactggcagcaggtccccttctgctcccaccacttccacgagctcatcatgaaggacgggcggaagctggtcgtgccgtgccgcccccaggacgagctgatcggccgggcgcgcatcagccagggggccggctggtccctccgggagacggcctgcctgggcaaggcctacgcgcagatgtggagcctgatgtacttccaccgccgcgacctccggctggcctccaacgccatctgcagcgccgtgcccgtccactgggtgcccacctcccgcaccacctggagcatccacgcccaccaccagtggatgacgaccgaggacatgctgaccgtgtggaaccgggtctggatcgaggacaacccgtggatggaggacaagacccccgtgacgacctgggagaacgtgccctacctcgggaagcgcgaggaccagtggtgcggcagcctgatcgggctgacctcccgggcgacctgggcccagaacatccccacggccatccagcaggtccgcagcctcatcggcaacgaggagttcctggactacatgccgtccatgaagcggttccgcaaggaggaggagagcgagggggccatctggtga

SEQ ID NO: 9990 - RNA, 9873 nt, synthetic construct
  misc_feature 1..9873: note = derived and/or modified CDS sequence (opt1) from DENV-3__FJ898441__SS-prME
  source 1..9873: mol_type = other RNA
accagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaagatggtccagtacgagaacctcaagtacaccgtgatcatcacggtgcacaccggggaccagcaccaggtcggcaacgagacccagggggtgaccgccgagatcacgccccaggccagcatcaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgcgatgcacaccgccctcaccggggccacggagatccagaacagcggcgggaccaccatcttcgccggccacctgaagtgccggctgaagatggacaagctcgagctgaagggcatgtcctacgccatgtgcaccaacacgttcgtgctgaagaaggaggtcagcgagacccagcacgggaccatcctcatcaaggtggagtacaagggcgaggacgcgccgtgcaagatccccttctccaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtcggcggggtgctcaactccctgggcaagatggtgcaccaggtcttcgggagcgcctacacggccctgttctccggcgtgagctgggtgatgaagatcggcatcggggtcctcctgacctggatcggcctgaactccaagaacaccagcatgtccttcagctgcatcgccatcgggatcatcaccctctacctgggcgccgtggtgcaggcggacacggggtgcgtcatcaactggaagggcaaggagctgaagtgcggctccgggatcttcgtgaccaacgaggtgcacacctggaccgagcagtacaagttccaggccgacagccccaagcgcctcgccacggccatcgccggcgcgtgggagaacggggtctgcggcatccgctccaccacccggatggagaacctgctgtggaagcagatcgccaacgagctcaactacatcctgtgggagaacaacatcaagctgaccgtggtggtcggggacatcatcggcgtgctcgagcagggcaagcgcacgctgaccccccagccgatggagctgaagtacagctggaagacctgggggaaggccaagatcgtgaccgccgagacgcagaactccagcttcatcatcgacggccccaacacccccgagtgcccctccgcgagccgggcctggaacgtctgggaggtggaggactacgggttcggcgtgttcaccaccaacatctggctcaagctgcgcgaggtctacacccagctgtgcgaccaccggctcatgtccgccgccgtgaaggacgagcgcgccgtgcacgcggacatgggctactggatcgagagccagaagaacgggagctggaagctggagaaggcctccctgatcgaggtcaagacgtgcacctggccgaagagccacaccctctggtccaacggcgtgctggagagcgacatgatcatccccaagtccctggccgggcccatcagccagcacaactaccggccgggctaccacacccagacggccgggccctggcacctcggcaagctggagctggacttcaactactgcgagggcaccaccgtggtcatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcagcgagaaggaggagaacatggtgaagtccctggtcagcgccggctccgggaaggtggacaacttcaccatgggcgtgctgtgcctcgcgatcctgttcgaggaggtcatgcgggggaagttcggcaagaagcacatgatcgtgggggtgttcttcaccttcgtcctgctcctgagcggccagatcacctggcgcgacatggcccacacgctgatcatgatcggctccaacgccagcgaccggatggggatgggcgtgacctacctcgccctgatcgccaccttcaagatccagcccttcctggcgctcgggttcttcctgcgcaagctgacctcccgggagaacctcctgctgggcgtgggcctcgccatggccacgaccctgcagctgcccgccgacatcgagcagatggcgaacgggatcgccctcggcctgatggccctgaagctcatcacccagttcgagacctaccagctgtggacggccctgatcagcctcacctgcagcaacaccatcttcaccctgacggtcgcctggcgcaccgcgaccctgatcctcgccggggtgtccctgctgccggtctgccagagctccagcatgcggaagaccgactggctccccatgacggtggccgccatgggcgtgcagcccctgcccctgttcatcttctccctcaaggacaccctgaagcgccgcagctggccgctgaacgagggggtcatggccgtgggcctcgtgtccatcctggcgagctccctgctccggaacgacgtccccatggccggccccctggtggccgggggcctgctcatcgcctgctacgtgatcaccgggaccagcgccgacctgacggtcgagaaggcggccgacgtgacctgggaggaggaggccgagcagaccggcgtgtcccacaacctgatgatcaccgtcgacgacgacgggaccatgcgcatcaaggacgacgagacggagaacatcctcaccgtgctgctgaagaccgccctcctgatcgtgagcggcatcttcccctactccatcccggccaccctgctcgtctggcacacgtggcagaagcagacccagcggagcggcgtgctgtgggacgtgccctccccccccgagacccagaaggcggagctggaggagggggtctaccgcatcaagcagcagggcatcttcgggaagacccaggtgggcgtgggggtccagaaggagggcgtgttccacacgatgtggcacgtgacccggggcgccgtcctcacctacaacgggaagcgcctggagccgaactgggccagcgtgaagaaggacctgatctcctacggcgggggctggcggctcagcgcccagtggcagaagggggaggaggtgcaggtcatcgcggtggagcccggcaagaaccccaagaacttccagaccatgcccggcacgttccagaccaccaccggggagatcggcgccatcgccctggacttcaagccggggacgtccggcagccccatcatcaaccgcgagggcaaggtggtcgggctgtacggcaacggggtggtgaccaagaacggcgggtacgtcagcggcatcgcccagaccaacgccgagcccgacggcccgacccccgagctggaggaggagatgttcaagaagcggaacctcacgatcatggacctgcaccccgggtccggcaagacccgcaagtacctgcccgcgatcgtgcgggaggccatcaagcgccggctccgcaccctgatcctggccccgacccgggtggtcgccgccgagatggaggaggcgctcaaggggctgcccatccgctaccagacgaccgccaccaagagcgagcacaccggccgggagatcgtggacctgatgtgccacgccacgttcaccatgcgcctcctgtcccccgtgcgggtccccaactacaacctgatcatcatggacgaggcccacttcaccgacccggccagcatcgcggcccgcgggtacatctccacccgggtgggcatgggcgaggccgccgcgatcttcatgacggccaccccccccgggaccgccgacgccttcccccagagcaacgccccgatccaggacgaggagcgcgacatccccgagcgctcctggaacagcggcaacgagtggatcaccgacttcgcggggaagacggtgtggttcgtcccctccatcaaggccggcaacgacatcgccaactgcctccggaagaacgggaagaaggtgatccagctgagccgcaagaccttcgacaccgagtaccagaagaccaagctgaacgactgggacttcgtggtcacgaccgacatctccgagatgggcgccaacttcaaggccgaccgggtgatcgacccccgccggtgcctcaagccggtgatcctgaccgacggccccgagcgcgtcatcctggcggggcccatgcccgtgaccgccgccagcgccgcccagcggcgcggccgggtggggcgcaacccgcagaaggagaacgaccagtacatcttcaccggccagcccctcaacaacgacgaggaccacgcgcactggacggaggccaagatgctgctggacaacatcaacacccccgaggggatcatccccgccctcttcgagccggagcgggagaagtccgccgcgatcgacggcgagtaccgcctgaagggcgagagccggaagaccttcgtcgagctgatgcgccggggggacctccccgtgtggctggcccacaaggtcgcctccgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctacagcgaccccctggccctcaaggagttcaaggacttcgcggccggccgcaagtccatcgccctggacctggtgaccgagatcgggcgggtcccgagccacctcgcccaccgcacccggaacgccctggacaacctggtgatgctccacacgtccgagcacggcgggcgcgcgtaccggcacgccgtggaggagctgcccgagaccatggagaccctgctcctgctgggcctcatgatcctgctgaccgggggcgccatgctcttcctgatcagcggcaaggggatcggcaagacgagcatcgggctgatctgcgtcatcgcctccagcggcatgctctggatggccgagatccccctgcagtggatcgcgtccgccatcgtgctggagttcttcatgatggtgctcctgatcccggagcccgagaagcagcgcaccccccaggacaaccagctggcctacgtcgtgatcgggatcctcaccctggccgccatcatcgcggccaacgagatgggcctgctcgagaccacgaagaaggacctgggcatgagcaaggagcccggggtggtctccagcacctcctacctggacgtggacctccacccggccagcgcctggaccctgtacgcggtggccaccacggtcatcacccccatgctgcggcacaccatcgagaactccaccgccaacgtgagcctcgccgccatcgcgaaccaggccgtggtcctgatgggcctggacaaggggtggcccatctccaagatggacctcggcgtgcccctgctggccctcgggtgctacagccaggtgaacccgctgacgctgaccgccgccgtcctcctgctgatcacccactacgcgatcatcggccccggcctccaggccaaggccacccgcgaggcccagaagcggacggccgcggggatcatgaagaaccccaccgtggacggcatcatgaccatcgacctggaccccgtgatctacgactccaagttcgagaagcagctggggcaggtcatgctcctggtgctgtgcgccgtgcagctcctgctgatgcgcaccagctgggccctctgcgaggccctgacgctggcgaccggcccgatcaccaccctctgggagggctcccccgggaagttctggaacacgaccatcgccgtcagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgccgtcagccgcggctccgccaagctgcagtggttcgtggagcggaacatggtgatccccgaggggcgcgtcatcgacctcggctgcgggcggggcgggtggagctactactgcgccggcctgaagaaggtgaccgaggtgcgcggctacacgaaggggggccccgggcacgaggagccggtccccatgtccacctacggctggaacatcgtgaagctgatgaccgggaaggacgtgttctacctcccccccgagaagtgcgacaccctgctgtgcgacatcggcgagagctccccgagccccacggtcgaggagtcccggaccatccgcgtgctgaagatggtggagccctggctcaagaacaaccagttctgcatcaaggtcctgaacccctacatgccgaccgtgatcgagcacctggagcgcctccagcggaagcacggcgggatgctggtgcgcaaccccctgagccggaactccacccacgagatgtactggatcagcaacggcacggggaacatcgtcgcgtccgtgaacatggtgagccgcctcctgctgaaccggttcaccatgacccaccgccggcccaccatcgagcgcgacgtcgacctcggcgccggcacgcggcacgtgaacgccgagcccgagaccccgaacatggacgtgatcggggagcgcatcaagcggatcaaggaggagcacaactccacctggcactacgacgacgagaacccctacaagacctgggcctaccacggcagctacgaggtcaaggccacggggtccgcgagctccatgatcaacggcgtggtcaagctgctgaccaagccctgggacgtggtgccgatggtcacccagatggccatgaccgacacgacccccttcgggcagcagcgcgtgttcaaggagaaggtggacacccggaccccccgcagcatgcccggcacgcggaaggtcatgggcatcaccgccgagtggctctggcgcaccctggggcggaacaagaagccgcgcctgtgcacccgggaggagttcacgaagaaggtgcgcaccaacgccgcgatgggcgccgtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaccatccccgggggcgccatgtacgcggacgacacggccgggtgggacacccggatcaccgaggacgacctgcacaacgaggagaagatcacccagcagatggaccccgagcaccgccagctcgccaacgccatcttcaagctgacctaccagaacaaggtggtgaaggtccagcggcccacgccgaccggcaccgtgatggacatcatctcccgcaaggaccagcggggcagcgggcaggtgggcacctacgggctgaacacgttcaccaacatggaggcccagctcatccgccagatggagggcgagggggtcctgtccaaggcggacctggagaacccccacctccccgagaagaagatcacccagtggctggagaccaagggcgtggagcggctgaagcgcatggccatcagcggcgacgactgcgtggtcaagcccatcgacgaccggttcgccaacgccctcctggccctgaacgacatggggaaggtgcgcaaggacatcccgcagtggcagccctccaagggctggcacgactggcagcaggtgcccttctgcagccaccacttccacgagctcatcatgaaggacgggcggaagctggtcgtgccctgccgcccgcaggacgagctgatcggccgggcgcgcatctcccagggggccggctggagcctccgggagacggcctgcctgggcaaggcctacgcgcagatgtggtccctgatgtacttccaccgccgcgacctccggctggccagcaacgccatctgctccgccgtgcccgtccactgggtgcccaccagccgcaccacctggtccatccacgcccaccaccagtggatgacgaccgaggacatgctgaccgtgtggaaccgggtctggatcgaggacaacccctggatggaggacaagaccccggtgacgacctgggagaacgtgccctacctcgggaagcgcgaggaccagtggtgcggcagcctgatcgggctgaccagccgggcgacctgggcccagaacatccccacggccatccagcaggtccgctccctcatcggcaacgaggagttcctggactacatgcccagcatgaagcggttccgcaaggaggaggagtccgagggggccatctggtga

SEQ ID NO: 9991 - RNA, 9873 nt, synthetic construct
  misc_feature 1..9873: note = derived and/or modified CDS sequence (opt1) from DENV-3__FJ898442__SS-prME
  source 1..9873: mol_type = other RNA
acctccctctgcctcatgatgatcctccccgccgccctcgcgttccacctcacctcccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaagatggtccagtacgagaacctcaagtacaccgtgatcatcacggtgcacaccggggaccagcaccaggtcggcaacgagacccagggggtgaccgccgagatcacgccccaggccagcatcaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgcgatgcacaccgccctcaccggggccacggagatccagaacagcggcgggaccaccatcttcgccggccacctgaagtgccggctgaagatggacaagctcgagctgaagggcatgtcctacgccatgtgcaccaacacgttcgtgctgaagaaggaggtcagcgagacccagcacgggaccatcctcatcaaggtggagtacaagggcgaggacgcgccgtgcaagatccccttctccaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtcggcggggtgctcaactccctgggcaagatggtgcaccaggtcttcgggagcgcctacacggccctgttctccggcgtgagctgggtgatgaagatcggcatcggggtcctcctgacctggatcggcctgaactccaagaacaccagcatgtccttcagctgcatcgccatcgggatcatcaccctctacctgggcgccgtggtgcaggcggacacggggtgcgtcatcaactggaagggcaaggagctgaagtgcggctccgggatcttcgtgaccaacgaggtgcacacctggaccgagcagtacaagttccaggccgacagccccaagcgcctcgccacggccatcgccggcgcgtgggagaacggggtctgcggcatccgctccaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtacagctggaagacctgggggaaggccaagatcgtgaccgccgagacgcagaactccagcttcatcatcgacggccccaacacccccgagtgcccctccgcgagccgggcctggaacgtctgggaggtggaggactacgggttcggcgtgttcaccaccaacatctggctcaagctgcgcgaggtctacacccagctgtgcgaccaccggctcatgtccgccgccgtgaaggacgagcgcgccgtgcacgcggacatgggctactggatcgagagccagaagaacgggagctggaagctggagaaggcctccctgatcgaggtcaagacgtgcacctggcccaagagccacaccctctggtccaacggcgtgctggagagcgacatgatcatcccccggtccctggccgggcccatcagccagcacaactaccgcccgggctaccacacccagacggccgggccctggcacctcggcaagctggagctggacttcaactactgcgagggcaccaccgtggtcatcaccgagaactgcgggacgcggggcccctccctccgcaccaccaccgtgagcgggaagctgatccacgagtggtgctgccggtcctgcacgctgcccccgctccgctacatgggcgaggacgggtgctggtacggcatggagatccggcccatcagcgagaaggaggagaacatggtgaagtccctggtcagcgccggctccgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgagcggccagatcacctggcgggacatggcccacacgctgatcatgatcggctccaacgccagcgaccgcatggggatgggcgtcacctacctcgccctgatcgcgaccttcaagatccagcccttcctggccctcgggttcttcctgcggaagctgacctcccgcgagaacctcctgctgggcgtgggcctcgccatggccacgaccctgcagctgcccgcggacatcgagcagatggccaacgggatcgccctcggcctgatggccctgaagctcatcacccagttcgagacctaccagctgtggacggccctgatcagcctgacctgcagcaacaccatcttcaccctgacggtggcgtggcggaccgccaccctgatcctcgccggggtctccctgctgccggtgtgccagagctccagcatgcgcaagaccgactggctccccatgacggtcgccgccatgggcgtgcagcccctgcccctgttcatcttctccctcaaggacaccctgaagcgccggagctggccgctgaacgagggggtgatggcggtcggcctcgtgtccatcctggccagctccctgctccgcaacgacgtgcccatggccggccccctggtcgccgggggcctgctcatcgcctgctacgtgatcaccgggaccagcgcggacctgacggtggagaaggccgccgacgtcacctgggaggaggaggccgagcagaccggcgtgtcccacaacctgatgatcaccgtggacgacgacgggaccatgcggatcaaggacgacgagacggagaacatcctcaccgtcctgctgaagaccgccctcctgatcgtgagcggcatcttcccctactccatcccggcgaccctgctcgtgtggcacacgtggcagaagcagacccagcgcagcggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacacgatgtggcacgtgacccgcggcgccgtgctcacctacaacgggaagcggctggagccgaactgggccagcgtcaagaaggacctgatctcctacggcgggggctggcgcctcagcgcgcagtggcagaagggggaggaggtccaggtgatcgccgtcgagcccggcaagaaccccaagaacttccagaccatgcccggcacgttccagaccaccaccggggagatcggcgccatcgccctggacttcaagccggggacgtccggcagccccatcatcaaccgggagggcaaggtggtggggctgtacggcaacggggtcgtgaccaagaacggcgggtacgtgagcggcatcgcccagaccaacgcggagcccgacggcccgacccccgagctggaggaggagatgttcaagaagcgcaacctcacgatcatggacctgcaccccgggtccggcaagacccggaagtacctgcccgccatcgtccgcgaggccatcaagcggcgcctccggaccctgatcctggccccgacccgcgtggtggccgcggagatggaggaggccctcaaggggctgcccatccggtaccagacgaccgccaccaagagcgagcacaccggccgcgagatcgtcgacctgatgtgccacgccacgttcaccatgcggctcctgtcccccgtgcgcgtgcccaactacaacctgatcatcatggacgaggcccacttcaccgacccggcgagcatcgccgcccgggggtacatctccacccgcgtcggcatgggcgaggccgcggccatcttcatgacggccacgccgcccgggaccgccgacgccttcccccagagcaacgcgccgatccaggacgaggagcgcgacatccccgagcggtcctggaacagcggcaacgagtggatcaccgacttcgccgggaagacggtgtggttcgtgccctccatcaaggccggcaacgacatcgccaactgcctccgcaagaacgggaagaaggtcatccagctgagccggaagaccttcgacaccgagtaccagaagaccaagctgaacgactgggacttcgtggtgacgaccgacatctccgagatgggcgccaacttcaaggcggaccgcgtcatcgacccccggcgctgcctcaagccggtgatcctgaccgacggccccgagcgggtgatcctggccgggcccatgcccgtcaccgccgccagcgccgcgcagcgccggggccgcgtggggcggaacccgcagaaggagaacgaccagtacatcttcaccggccagcccctcaacaacgacgaggaccacgcccactggacggaggccaagatgctgctggacaacatcaacacccccgaggggatcatccccgccctcttcgagccggagcgcgagaagtccgcggccatcgacggcgagtaccggctgaagggcgagagccgcaagaccttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtcgagatctggacgaaggagggcgagaagaagaagctccggccccgctggctggacgcccgcacctacagcgaccccctggcgctcaaggagttcaaggacttcgccgccggccggaagtccatcgccctggacctggtgaccgagatcgggcgcgtgccgagccacctcgcccaccggacccgcaacgcgctggacaacctggtcatgctccacacgtccgagcacggcgggcgggcctaccgccacgccgtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggcggagatccccctgcagtggatcgcctccgccatcgtcctggagttcttcatgatggtgctcctgatcccggagcccgagaagcagcggacgccccaggacaaccagctggcctacgtggtcatcgggatcctcaccctggccgcgatcatcgccgccaacgagatgggcctgctcgagaccacgaagaaggacctgggcatgagcaaggagcccggggtggtgtccagcacctcctacctggacgtcgacctccacccggccagcgcgtggaccctgtacgccgtggccaccacggtgatcacccccatgctgcgccacaccatcgagaactccaccgccaacgtcagcctcgccgcgatcgccaaccaggccgtggtgctgatgggcctggacaaggggtggcccatctccaagatggacctcggcgtccccctgctggccctcgggtgctacagccaggtgaacccgctgacgctgaccgccgcggtgctcctgctgatcacccactacgccatcatcggccccggcctccaggccaaggccacccgggaggcccagaagcgcacggcggccgggatcatgaagaaccccaccgtcgacggcatcatgaccatcgacctggaccccgtgatctacgactccaagttcgagaagcagctgggccaggtgatgctcctggtcctgtgcgccgtgcagctcctgctgatgcggaccagctgggccctctgcgaggcgctgacgctggccaccggcccgatcaccaccctctgggagggctcccccgggaagttctggaacacgaccatcgccgtgagcatggccaacatcttccgcggctcctacctggccggggcgggcctggccttcagcatcatgaagtccgtcgggaccggcaagcggggcaccgggagccagggcgagaccctcggggagaagtggaagaagaagctgaaccagctgagccgcaaggagttcgacctctacaagaagtccggcatcacggaggtggaccggaccgaggccaaggaggggctgaagcgcggcgagatcacccaccacgccgtgagccggggctccgccaagctgcagtggttcgtcgagcgcaacatggtgatccccgaggggcgggtgatcgacctcggctgcgggcgcggcgggtggagctactactgcgcgggcctgaagaaggtcaccgaggtgcggggctacacgaagggcgggcccgggcacgaggagccggtgcccatgtccacctacggctggaacatcgtcaagctgatgaccgggaaggacgtgttctacctgccgcccgagaagtgcgacaccctgctgtgcgacatcggcgagagctccccgagccccacggtggaggagtcccgcaccatccgcgtcctgaagatggtggagccctggctcaagaacaaccagttctgcatcaaggtgctgaacccctacatgccgaccgtcatcgagcacctggagcggctccagcgcaagcacggcgggatgctggtgcggaaccccctgagccgcaactccacccacgagatgtactggatcagcaacggcacggggaacatcgtggcctccgtcaacatggtgagccggctcctgctgaaccgcttcaccatgacccaccggcgccccaccatcgagcgggacgtggacctcggcgccggcacgcgccacgtcaacgccgagcccgagaccccgaacatggacgtgatcggggagcggatcaagcgcatcaaggaggagcacaactccacctggcactacgacgacgagaacccctacaagacctgggcctaccacggcagctacgaggtgaaggcgacggggtccgccagctccatgatcaacggcgtcgtgaagctgctgaccaagccctgggacgtcgtgccgatggtgacccagatggccatgaccgacacgacccccttcgggcagcagcgggtcttcaaggagaaggtggacacccgcacgccccggagcatgcccggcacgcgcaaggtgatgggcatcaccgccgagtggctctggcggaccctggggcgcaacaagaagccgcggctgtgcacccgcgaggagttcacgaagaaggtccgcaccaacgcggccatgggcgccgtgttcaccgaggagaaccagtgggacagcgccaaggccgcggtggaggacgaggagttctggaagctcgtcgaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaccatccccgggggcgcgatgtacgccgacgacacggccgggtgggacacccgcatcaccgaggacgacctgcacaacgaggagaagatcacccagcagatggaccccgagcaccggcagctcgccaacgccatcttcaagctgacctaccagaacaaggtcgtgaaggtgcagcgccccacgccgaccggcaccgtcatggacatcatctcccggaaggaccagcgcggcagcggccaggtgggcacctacgggctgaacacgttcaccaacatggaggcgcagctcatccggcagatggagggcgagggggtgctgtccaaggccgacctggagaacccccacctccccgagaagaagatcacccagtggctggagaccaagggcgtcgagcgcctgaagcggatggccatcagcggcgacgactgcgtggtgaagcccatcgacgaccgcttcgccaacgccctcctggcgctgaacgacatggggaaggtccggaaggacatcccgcagtggcagccctccaagggctggcacgactggcagcaggtccccttctgcagccaccacttccacgagctcatcatgaaggacgggcgcaagctggtggtcccctgccggccgcaggacgagctgatcggccgcgcccggatctcccagggggccggctggagcctccgcgagacggcctgcctgggcaaggcgtacgcccagatgtggtccctgatgtacttccaccgccgggacctccgcctggccagcaacgccatctgctccgccgtgcccgtgcactgggtccccaccagccggaccacctggtccatccacgcgcaccaccagtggatgacgaccgagaacatgctgaccgtgtggaaccgcgtgtggatcgaggacaacccctggatggaggacaagaccccggtcacgacctgggagaacgtgccctacctcgggaagcgggaggaccagtggtgcggcagcctgatcgggctgaccagccgcgccacctgggcccagaacatccccacggccatccagcaggtccggtccctcatcggcaacgaggagttcctggactacatgcccagcatgaagcgcttccggaaggaggaggagtccgagggggccatctggtga

SEQ ID NO: 9992 - RNA, 9873 nt, synthetic construct
  misc_feature 1..9873: note = derived and/or modified CDS sequence (opt1) from DENV-3__FJ882575__SS-prME
  source 1..9873: mol_type = other RNA
accagcctgtgcctgatgatgatcctgcccgccaccctggccttccacctcaccagccgggacggcgagccgcggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacgtacgggacctgcaaccaggccggcgagcaccggcgcgacaagcggtccgtggccctcgcgccccacgtgggcatggggctggacacccgcacccagacgtggatgagcgcggagggcgcctggcggcaggtcgagaaggtggagacctgggccctgcgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcggtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggccatcctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgccccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcgggatcctcaacagcctgggcaagatggtgcaccagatcttcgggtccgcgtacaccgccctgttcagcggcgtctcctgggtgatgaagatcggcatcggggtgctcctgacctggatcggcctgaacagcaagaacacctccatgagcttctcctgcatcgccatcgggatcatcacgctctacctgggcgccgtcgtgcaggccgacatggggtgcgtgatcaactggaagggcaaggagctgaagtgcggcagcgggatcttcgtcaccaacgaggtgcacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtcgtggtgggggacacgatcggcgtcctcgagcagggcaagcgcaccctgacgccccagccgatggagctgaagtactcctggaagacctgggggaaggccaagatcgtgacggccgagacccagaacagctccttcatcatcgacggccccaacacccccgagtgccccagcgcctcccgggcgtggaacgtgtgggaggtcgaggactacgggttcggcgtgttcaccaccaacatctggctcaagctgcgcgaggtgtacacgcagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacctggccgaagtcccacaccctctggagcaacggcgtcctggagtccgacatgatcatccccaagagcctggccgggcccatctcccagcacaactaccggccgggctaccacacgcagaccgccgggccctggcacctcggcaagctggagctggacttcaactactgcgagggcaccaccgtggtgatcacggagaactgcgggacccgcggccccagcctccggaccaccacggtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcttcttcaccttcgtgctgctcctgtccggccagatcacgtggcgcgacatggcccacaccctgatcatgatcggcagcaacgcctccgaccggatggggatgggcgtgacctacctcgccctgatcgccaccttcaagatccagcccttcctggcgctcgggttcttcctgcgcaagctgacgagccgggagaacctcctgctgggcgtcggcctcgccatggccaccaccctgcagctgcccgaggacatcgagcagatggccaacgggatcgcgctcggcctgatggccctgaagctcatcacccagttcgagacgtaccagctgtggaccgccctgatcagcctgacctgctccaacaccatcttcacgctgaccgtggcctggcgcaccgccaccctgatcctcgcgggggtgagcctgctgccggtctgccagtccagctccatgcggaagacggactggctccccatgaccgtggccgccatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacgtccgccgacctgaccgtggagaaggccgcggacgtgacctgggaggaggaggccgagcagaccggcgtcagccacaacctgatgatcaccgtggacgacgacgggacgatgcgcatcaaggacgacgagaccgagaacatcctcaccgtgctgctgaagaccgccctcctgatcgtctccggcatcttcccgtacagcatccccgccacgctgctcgtgtggcacacctggcagaagcagacccagcggtccggcgtgctgtgggacgtccccagcccgcccgagacccagaaggccgagctggaggagggggtgtaccgcatcaagcagcagggcatcctcgggaagacccaggtgggcgtcggggtgcagaaggagggcgtgttccacaccatgtggcacgtcacccggggcgcggtgctgacccacaacgggaagcgcctggagcccaactgggcctccgtgaagaaggacctcatcagctacggcgggggctggcggctgtccgcccagtggcagaagggggaggaggtccaggtgatcgccgtggagcccggcaagaaccccaagaacttccagacgatgcccggcaccttccagaccaccacgggggagatcggcgcgatcgccctggacttcaagcccgggaccagcggcagccccatcatcaaccgcgagggcaaggtcgtggggctgtacggcaacggggtggtcaccaagaacggcgggtacgtgtccggcatcgcccagaccaacgccgagccggacggccccacgcccgagctcgaggaggagatgttcaagaagcggaacctgaccatcatggacctgcaccccgggagcggcaagacccgcaagtacctcccggccatcgtgcgggaggcgatcaagcgccggctgcgcaccctgatcctcgcccccacgcgggtcgtggccgccgagatggaggaggccctgaaggggctgcccatccgctaccagaccaccgcgaccaagtccgagcacacgggccgggagatcgtggacctcatgtgccacgccaccttcaccatgcgcctgctgagccccgtccgggtgccgaactacaacctcatcatcatggacgaggcccacttcaccgaccccgcctccatcgccgcgcgcgggtacatcagcacgcgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcacggacttcgccgggaagaccgtctggttcgtgcccagcatcaaggcgggcaacgacatcgccaactgcctgcggaagaacgggaagaaggtgatccagctgtcccgcaagaccttcgacaccgagtaccagaagacgaagctcaacgactgggacttcgtcgtgaccaccgacatcagcgagatgggcgccaacttcaaggccgaccgggtgatcgacccgcgccggtgcctgaagcccgtcatcctgaccgacggccccgagcgcgtgatcctcgccgggcccatgccggtgaccgcggcctccgccgcccagcggcgcggccgggtcgggcgcaacccccagaaggagaacgaccagtacatcttcacgggccagcccctgaacaacgacgaggaccacgcccactggaccgaggcgaagatgctgctcgacaacatcaacacccccgaggggatcatcccggccctgttcgagcccgagcgggagaagtccgccgccatcgacggcgagtaccgcctgaagggcgagtcccggaagaccttcgtggagctcatgcgccgcggggacctgcccgtgtggctggcgcacaaggtcgccagcgagggcatcaagtacacggaccgcaagtggtgcttcgacgggcagcggaacaaccagatcctcgaggagaacatggacgtggagatctggaccaaggagggcgagaagaagaagctgcgcccccggtggctggacgcccgcacctactccgacccgctcgccctgaaggagttcaaggacttcgccgcgggccgcaagagcatcgccctggacctcgtcaccgagatcgggcgggtgccctcccacctggcccaccgcacgcggaacgccctggacaacctcgtgatgctgcacaccagcgagcacggcgggcgcgcctaccggcacgcggtcgaggagctgcccgagaccatggagaccctcctgctgctcggcctgatgatcctgctcaccggcggggccatgctgttcctgatcagcgggaaggggatcggcaagacctccatcgggctcatctgcgtgatcgccagctccggcatgctgtggatggccgagatcccgctgcagtggatcgccagcgcgatcgtgctcgagttcttcatgatggtcctgctgatccccgagcccgagaagcagcgcacgccccaggacaaccagctcgcctacgtggtgatcgggatcctgaccctggccgccatcatcgccgcgaacgagatgggcctcctggagacgaccaagcgggacctgggcatgtccaaggagccgggggtcgtgagccccacctcctacctcgacgtggacctgcaccccgccagcgcctggaccctgtacgccgtcgcgacgaccgtgatcacccccatgctccgccacaccatcgagaactccacggccaacgtgagcctggccgccatcgccaaccaggcggtcgtgctgatgggcctcgacaaggggtggccgatctccaagatggacctgggcgtgcccctgctcgccctggggtgctacagccaggtcaaccccctgaccctcaccgccgccgtgctgctgctcatcacccactacgccatcatcggccccggcctgcaggcgaaggccacgcgggaggcccagaagcgcaccgccgccgggatcatgaagaacccgaccgtggacggcatcatgaccatcgacctggaccccgtcatctacgactccaagttcgagaagcagctcggccaggtgatgctgctggtgctctgcgcggtccagctgctgctcatgcggacgagctgggccctgtgcgaggccctgaccctcgccaccggccccatcaccacgctgtgggagggctcccccgggaagttctggaacaccaccatcgcggtgagcatggccaacatcttccgcggctcctacctggccggggccggcctcgccttcagcatcatgaagtccgtggggaccggcaagcggggcaccgggagccagggcgagacgctgggggagaagtggaagaagaagctgaaccagctcagccgcaaggagttcgacctgtacaagaagtccggcatcaccgaggtcgaccggaccgaggcgaaggaggggctgaagcgcggcgagatcacccaccacgccgtgagccggggctccgccaagctccagtggttcgtggagcgcaacatggtcatcccggaggggcgggtgatcgacctgggctgcgggcgcggcgggtggagctactactgcgccggcctgaagaaggtgacggaggtccggggctacaccaagggcgggcccgggcacgaggagcccgtgcccatgtccacctacggctggaacatcgtgaagctcatgagcgggaaggacgtcttctacctgccgcccgagaagtgcgacaccctgctgtgcgacatcggcgagtccagcccctcccccacggtggaggagagccgcaccatccgcgtgctcaagatggtcgagccgtggctgaagaacaaccagttctgcatcaaggtgctgaacccctacatgcccaccgtgatcgagcacctcgagcggctgcagcgcaagcacggcgggatgctggtccggaaccccctctcccgcaacagcacccacgagatgtactggatctccaacggcacggggaacatcgtgagctccgtgaacatggtcagccggctgctgctcaaccgcttcaccatgacccaccggcgcccgaccatcgagaaggacgtggacctgggcgccggcacgcggcacgtggacgcggagcccgagacccccaacatggacgtcatcggggagcgcatcaagcggatcaaggaggagcacaactccacctggcactacgacgacgagaacccgtacaagacctgggcctaccacggcagctacgaggtgaaggccacggggtccgccagcagcatgatcaacggcgtggtcaagctgctcaccaagccctgggacgtggtccccatggtgacccagatggccatgaccgacacgacccccttcgggcagcagcgcgtgttcaaggagaaggtcgacacccggaccccgcgccccatgcccggcacgcggaaggtgatgggcatcaccgcggagtggctgtggcgcaccctggggcggaacaagcgcccccggctctgcacccgcgaggagttcacgaagaaggtgcgcaccaacgccgccatgggcgccgtcttcaccgaggagaaccagtgggactccgcgaaggccgccgtggaggacgaggagttctggaagctggtggaccgggagcgcgagctgcacaagctcgggaagtgcggcagctgcgtctacaacatgatggggaagcgggagaagaagctgggcgagttcggcaaggccaaggggtcccgcgccatctggtacatgtggctgggcgcgcggtacctcgagttcgaggccctggggttcctgaacgaggaccactggttcagccgcgagaactcctacagcggcgtggagggggagggcctccacaagctgggctacatcctgcgggacatctccaagatccccgggggcgccatgtacgccgacgacaccgccgggtgggacacgcgcatcaccgaggacgacctccacaacgaggagaagatcacccagcagatggaccccgagcaccggcagctggcgaacgccatcttcaagctgacctaccagaacaaggtggtcaaggtgcagcgccccacccccacgggcaccgtgatggacatcatcagccggaaggaccagcgcggctccgggcaggtcggcacctacgggctcaacaccttcacgaacatggaggcccagctggtgcggcagatggagggcgagggggtgctgagcaaggccgacctcgagaacccgcacctccccgagaagaagatcacccagtggctggagaccaagggcgtcgagcgcctcaagcggatggccatctccggcgacgactgcgtggtgaagcccatcgacgaccgcttcgcgaacgccctgctggccctcaacgacatggggaaggtccggaaggacatcccccagtggcagccgagcaagggctggcacgactggcagcaggtccccttctgctcccaccacttccacgagctgatcatgaaggacgggcgcaagctggtggtcccctgccggccccaggacgagctcatcggccgcgcccggatcagccagggggccggctggtccctgcgcgagaccgcgtgcctgggcaaggcctacgcccagatgtggagcctcatgtacttccaccgccgggacctgcgcctggcctccaacgcgatctgcagcgccgtgccggtgcactgggtccccacgtcccggaccacctggagcatccacgcccaccaccagtggatgaccacggaggacatgctcaccgtgtggaaccgcgtgtggatcgaggacaacccctggatggaggacaagacccccgtcaccacgtgggagaacgtgccgtacctggggaagcgggaggaccagtggtgcggcagcctgatcgggctcacctcccgcgccacctgggcccagaacatccccaccgcgatccagcaggtccggagcctgatcggcaacgaggagttcctggactacatgccctccatgaagcgcttccggaaggaggaggagagcgagggggccatctggtga

SEQ ID NO: 9993 - RNA, 9873 nt, synthetic construct
  misc_feature 1..9873: note = derived and/or modified CDS sequence (opt1) from DENV-3__GQ199886__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatgggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagaaggacatccccgagcgcagctggaactccggcaacgagtggatcaccgacttcgccgggaagacggtgtggttcgtccccagcatcaaggcgggcaacgacatcgccaactgcctccgcaagaacgggaagaaggtgatccagctgtcccggaagaccttcgacaccgagtaccagaagaccaagctgaacgactgggacttcgtggtcacgaccgacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccggacctactccgacccgctggccctcaaggagttcaaggacttcgccgcgggccgcaagagcatcgccctggacctggtgaccgagatcgggcgcgtcccctcccacctcgcccaccggacccgcaacgccctggacaacctggtgatgctccacacgagcgagcacggcgggcgggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgtccaaggagccgggggtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgacgctggccaccggccccatcaccaccctctgggagggctcccccgggaagttctggaacacgaccatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggccgacctggagaacccccacctcccggagaagaagatcacgcagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 9994 - RNA, 9873 nt, synthetic construct
  misc_feature 1..9873: note = derived and/or modified CDS sequence (opt1) from DENV-3__FJ882576__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatggccatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacatggggtgcgtgatcaactggaagggcaaggagctgaagtgcggcagcgggatcttcgtgaccaacgaggtccacacgtggaccgagcagtacaagttccaggccgactcccccaagcgcctcgccaccgccatcgccggcgcgtgggagaacggggtgtgcggcatccgcagcaccacgcggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacgtgggggaaggccaagatcgtcaccgccgagacccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgaccggatggggatgggcgtgacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatcttcaccctgaccgtcgcctggcgcaccgcgacgctgatcctcgccggggtgagcctgctgccggtctgccagtccagctccatgcggaagaccgactggctccccatgaccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacgtgacctgggaggaggaggccgagcagacgggcgtgagccacaacctgatgatcaccgtcgacgacgacgggaccatgcgcatcaaggacgacgagaccgagaacatcctcaccgtgctgctgaagacggccctcctgatcgtgtccggcatcttcccgtacagcatccccgccaccctgctcgtctggcacacctggcagaagcagacccagcggtccggcgtgctgtgggacgtgcccagcccgcccgagacgcagaaggcggagctggaggagggggtctaccgcatcaagcagcagggcatcttcgggaagacccaggtgggcgtgggggtccagaaggagggcgtgttccacaccatgtggcacgtgacccggggcgccgtcctcgcctacaacgggaagcgcctggagcccaactgggcctccgtgaagaaggacctgatcagctacggcgggggctggcggctctccgcgcagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagaccaacgcggagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtggtcgccgcggagatggaggaggccctcaaggggctgcccatccgctaccagaccaccgccaccaagtccgagcacacgggccgggagatcgtggacctgatgtgccacgccaccttcaccatgcgcctcctgagccccgtgcgggtcccgaactacaacctgatcatcatggacgaggcccacttcaccgaccccgcgtccatcgccgcccgcgggtacatcagcacgcgggtgggcatgggcgaggccgcggccatcttcatgaccgccacgccgcccgggaccgccgacgccttcccgcagtccaacgcgcccatccaggacgaggagcgcgacatccccgagcgcagctggaactccggcaacgagtggatcacggacttcgccgggaagaccgtgtggttcgtccccagcatcaaggccggcaacgacatcgccaactgcctccggaagaacgggaagaaggtgatccagctgtcccgcaagaccttcgacaccgagtaccagaagacgaagctgaacgactgggacttcgtggtcaccaccgacatcagcgagatgggcgccaacttcaaggcggaccgggtgatcgacccgcgccggtgcctcaagcccgtgatcctgaccgacggccccgagcgcgtcatcctggccgggcccatgccggtgacggccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagaccttcgtcgagctgatgcgccgcggggacctccccgtgtggctggcccacaaggtcgccagcgagggcatcaagtacacggaccgcaagtggtgcttcgacggggagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtgaccgagatcgggcgggtcccctcccacctcgcccaccgcacgcggaacgcgctggacaacctggtgatgctccacaccagcgagcacggcgggcgcgcctaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcgcacgccccaggacaaccagctggcctacgtcgtgatcgggatcctcaccctggccgcgatcatcgccgccaacgagatgggcctgctcgagacgaccaagcgggacctgggcatgtccaaggagccgggggtggtcagccccacctcctacctggacgtggacctccaccccgccagcgcgtggaccctgtacgccgtggccacgaccgtcatcacccccatgctgcgccacaccatcgagaactccacggccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacccactacgccatcatcggccccggcctccaggccaaggccacgcgggaggcccagaagcgcaccgcggccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcggacgagctgggccctctgcgaggcgctgaccctggccaccggccccatcaccacgctctgggagggctcccccgggaagttctggaacaccaccatcgccgtcagcatggccaacatcttccgcggctcctacctggccggggcgggcctggccttcagcatcatgaagtccgtggggaccggcaagcggggcacggggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgcgggcctgaagaaggtgacggaggtgcggggctacaccaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccacggtcgaggagagccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgtcccgcaacagcacccacgagatgtactggatctccaacggcacggggaacatcgtcagctccgtgaacatggtgagccggctcctgctgaaccgcttcaccatgacccaccggcgcccgaccatcgagaaggacgtcgacctcggcgccggcacgcggcacgtgaacgccgagcccgagacccccaacatggacgtgatcggggagcgcatcaagcggatcaaggaggagcacaactccacctggcactacgacgacgagaacccgtacaagacctgggcctaccacggcagctacgaggtcaaggccacggggtccgcgagcagcatgatcaacggcgtggtcaagctgctgaccaagccctgggacgtggtgcccatggtcacccagatggccatgaccgacacgacccccttcgggcagcagcgcgtgttcaaggagaaggtggacacccggaccccgcgctccatgcccggcacgcggcgcgtcatgggcatcaccgccgagtggctctggcggaccctggggcgcaacaagaagccccggctgtgcacccgcgaggagttcacgaagaaggtgcgcaccaacgccgcgatgggcgccgtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgcggacgacaccgccgggtgggacacgcgcatcaccgaggacgacctgcacaacgaggagaagatcacccagcagatggacccggagcaccggcagctcgccaacgccatcttcaagctgacctaccagaacaaggtggtgaaggtccagcgccccacgcccaccggcaccgtgatggacatcatctcccggaaggaccagcgcggcagcggccaggtgggcacctacgggctgaacaccttcacgaacatggaggcccagctcatccggcagatggagggcgagggggtcctgtccaaggcggacctggagaacccccacctcccggagaagaagatcacccagtggctggagaccaagggcgtggagcgcctgaagcggatggccatcagcggcgacgactgcgtggtcaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcgcggatctcccagggggccggctggagcctccgcgagaccgcctgcctgggcaaggcctacgcgcagatgtggtccctgatgtacttccaccgccgggacctccgcctggccagcaacgccatctgctccgccgtgcccgtccactgggtgccgacgagccggaccacctggagcatccacgcccaccaccagtggatgaccacggaggacatgctgaccgtgtggaaccgcgtctggatcgaggacaacccctggatggaggacaagacccccgtgaccacgtgggagaacgtgccctacctcgggaagcgggaggaccagtggtgcggctccctgatcgggctgaccagccgcgcgacctgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 9995 - RNA, 9873 nt, synthetic construct
  misc_feature 1..9873: note = derived and/or modified CDS sequence (opt1) from DENV-3__FJ850052__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacaaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcaccatgacgcaccggcgcccgaccatcgagaaggacgtggacctcggcgcggggacccggcacgtcaacgccgagcccgagacccccaacatggacgtgatcggcgagcgcatcaagcggatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggcgatgaccgacaccacccccttcggccagcagcgcgtcttcaaggagaaggtggacacgcggaccccgcgcagcatgcccggcacccggcgcgtgatggggatcaccgccgagtggctctggcggacgctgggccgcaacaagaagccccggctgtgcacccgcgaggagttcaccaagaaggtccgcaccaacgccgccatgggggcggtgttcacggaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatctcccggaaggaccagcgcgggagcggccaggtggggacgtacggcctgaacaccttcaccaacatggaggcccagctcatccggcagatggagggggagggcgtgctgtccaaggccgacctggagaacccccacctcccggagaagaagatcacccagtggctggagacgaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgaccagccgggccacgtgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 9996 - RNA, 9873 nt, synthetic construct
  misc_feature 1..9873: note = derived and/or modified CDS sequence (opt1) from DENV-3__FJ873812__SS-prME
  source 1..9873: mol_type = other RNA
accagcctgtgcctcatgatgatcctgcccgcggccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatctccaacgagctcaactacatcctgtgggagaacaacatcaagctgaccgtggtggtcggggacatcatcggcgtgctcgagcagggcaagcgcacgctgacgccccagccgatggagctgaagtacagctggaagacctgggggaaggcgaagatcgtgaccgccgagacgcagaactccagcttcatcatcgacggccccaacacccccgagtgcccctccgtcagccgggcctggaacgtgtgggaggtggaggactacgggttcggcgtcttcaccaccaacatctggctcaagctgcgcgaggtgtacacccagctgtgcgaccaccggctcatgagcgccgcggtgaaggacgagcgcgccgtccacgccgacatgggctactggatcgagtcccagaagaacgggagctggaagctggagaaggcctccctgatcgaggtgaagacgtgcacctggcccaagagccacaccctctggtccaacggcgtgctggagagcgacatgatcatccccaagtccctggccgggcccatcagccagcacaaccaccggccgggctaccacacccagacggcggggccctggcacctcggcaagctggagctggacttcaactactgcgagggcaccaccgtcgtgatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcagcgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgttcctgaccttcgtcctcctgctgagcggccagatcacctggcgcgacatggcccacacgctcatcatgatcggctccaacgcgagcgaccggatggggatgggcgtgacctacctggccctgatcgccaccttcaagatccagcccttcctcgccctggggttcttcctgcgcaagctcaccagccgggagaacctgctgctcggcgtgggcctggccatggcgacgaccctgcagctccccgaggacatcgagcagatggccaacgggatcgccctgggcctgatggccctcaagctgatcacccagttcgagacctaccagctgtggacggcgctcatctccctgacctgcagcaacaccatcttcaccctgacggtcgcctggcgcaccgccaccctcatcctggccggggtgtccctgctcccggtctgccagagctccagcatgcggaagaccgactggctgcccatggccgtggcggccatgggcgtgccgcccctgcccctgttcatcttctccctgaaggacacgctgaagcgccgcagctggcccctcaacgagggggtcatggccgtgggcctggtgtccatcctggccagctccctcctgcggaacgacgtccccatggccggccccctggtggccggcgggctcctgatcgcctgctacgtgatcaccgggaccagcgccgacctgaccgtcgagaaggccgccgacatcacgtgggaggaggaggcggagcagaccggggtgtcccacaacctcatgatcaccgtggacgacgacgggaccatgcgcatcaaggacgacgagaccgagaacatcctgacggtcctgctcaagaccgccctgctgatcgtgagcggcatcttcccgtactccatccccgccaccctcctggtgtggcacacctggcagaagcagacgcagcggagcggcgtcctgtgggacgtgcccagcccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacctacaacgggaagcgcctggagcccaactgggcgagcgtcaagaaggacctcatctcctacggcgggggctggcggctgagcgcccagtggcagaagggggaggaggtccaggtgatcgccgtcgagcccggcaagaaccccaagaacttccagaccatgccgggcaccttccagacgaccaccggggagatcggcgccatcgcgctggacttcaagcccgggaccagcggctcccccatcatcaaccgcgagggcaaggtggtggggctgtacggcaacggggtcgtgacgaagaacggcgggtacgtgagcggcatcgcccagaccaacgccgagccggacggccccacccccgagctcgaggaggagatgttcaagaagcggaacctgaccatcatggacctgcaccccgggtccggcaagacgcgcaagtacctcccggccatcgtccgggaggccatcaagcgccggctgcgcaccctgatcctcgcgcccacccgggtggtggccgccgagatggaggaggccctgaaggggctgcccatccgctaccagaccacggccaccaagagcgagcacaccggccgggagatcgtcgacctcatgtgccacgcgaccttcacgatgcgcctgctgtcccccgtgcgggtgccgaactacaacctcatcatcatggacgaggcccacttcaccgaccccgccagcatcgccgcccgcgggtacatctccacccgggtcggcatgggcgaggcggccgccatcttcatgaccgccacgccgcccgggaccgcggacgccttcccgcagagcaacgcccccatccaggacgaggagcgcgacatccccgagcgctcctggaacagcggcaacgagtggatcaccgacttcgccgggaagaccgtgtggttcgtgccctccatcaaggccggcaacgacatcgcgaactgcctgcggaagaacgggaagaaggtcatccagctgagccgcaagacgttcgacaccgagtaccagaagaccaagctcaacgactgggacttcgtggtgaccacggacatctccgagatgggcgccaacttcaaggccgaccgggtcatcgacccgcgccggtgcctgaagcccgtgatcctgaccgacggccccgagcgcgtgatcctcgccgggcccatgccggtcaccgccgcgagcgccgcccagcggcgcggccgggtggggcgcaacccccagaaggagaacgaccagtacatcttcaccggccagcccctgaacaacgacgaggaccacgcccactggaccgaggccaagatgctgctcgacaacatcaacacgcccgaggggatcatcccggcgctgttcgagcccgagcgggagaagtccgccgccatcgacggcgagtaccgcctgaagggcgagagccggaagaccttcgtggagctcatgcgccgcggggacctgcccgtctggctggcccacaaggtggcgtccgagggcatcaagtacaccgaccgcaagtggtgcttcgacgggcagcggaacaaccagatcctcgaggagaacatggacgtcgagatctggaccaaggagggcgagaagaagaagctgcgcccccggtggctggacgcccgcacgtacagcgacccgctcgccctgaaggagttcaaggagttcgccgccggccgcaagtccatcgcgctggacctcgtgaccgagatcgggcgggtgcccagccacctggcccaccgcacccggaacgccctggacaacctcgtcatgctgcacaccagcgagcacggcgggcgcgcctaccggcacgccgtggaggagctgcccgagacgatggagaccctcctgctgctcggcctgatgatcctgctcaccgggggcgcgatgctgttcctgatctccggcaaggggatcggcaagaccagcatcgggctcatctgcgtgatcgcctccagcggcatgctgtggatggccgagatcccgctgcagtggatcgcctccgccatcgtcctcgagttcttcatgatggtgctgctgatccccgagcccgagaagcagcgcacgccccaggacaaccagctcgcgtacgtggtcatcgggatcctgaccctggccgccatcatcgccgccaacgagatgggcctcctggagaccaccaagcgggacctgggcatgagcaaggagccgggggtggtgtcccccacgagctacctcgacgtcgacctgcaccccgcgtccgcctggaccctgtacgccgtggccaccaccgtgatcacgcccatgctccgccacaccatcgagaacagcaccgcgaacgtctccctggccgccatcgccaaccaggccgtggtgctgatgggcctcgacaaggggtggccgatcagcaagatggacctgggcgtccccctgctcgcgctggggtgctactcccaggtgaaccccctgaccctcacggccgccgtgctgctgctcatcacccactacgccatcatcggccccggcctgcaggccaaggcgacccgggaggcccagaagcgcaccgccgccgggatcatgaagaacccgacggtcgacggcatcatgaccatcgacctggaccccgtgatctacgacagcaagttcgagaagcagctcggccaggtgatgctgctggtcctctgcgccgtgcagctgctgctcatgcggacctcctgggcgctgtgcgaggccctgaccctcgccacgggccccatcaccaccctgtgggagggcagccccgggaagttctggaacaccacgatcgccgtgtccatggcgaacatcttccgcggcagctacctggccggggccggcctcgccttctccatcatgaagtccgtcgggaccggcaagcggggcaccgggagccagggcgagaccctgggggagaagtggaagaagaagctgaaccagctctcccgcaaggacttcgacctgtacaagaagtccggcatcaccgaggtggaccggacggaggccaaggaggggctgaagcgcggcgagatcacccaccacgcggtgtcccggggcagcgccaagctccagtggttcgtcgagcgcaacatggtgatcccggaggggcgggtgatcgacctgggctgcgggcgcggcgggtggtcctactactgcgccggcctgaagaaggtcaccgaggtgcggggctacaccaagggcgggcccgggcacgaggagcccgtgcccatgagcacgtacggctggaacatcgtcaagctcatgtccgggaaggacgtgttctacctgccgcccgagaagtgcgacaccctgctgtgcgacatcggcgagagctcccccagccccaccgtggaggagtcccgcaccatccgcgtcctcaagatggtggagccgtggctgaagaacaaccagttctgcatcaaggtgctgaacccctacatgcccacggtcatcgagcacctcgagcggctgcagcgcaagcacggcgggatgctggtgcggaaccccctcagccgcaactccacccacgagatgtactggatcagcaacggcaccgggaacatcgtggcctccgtcaacatggtgagccggctgctgctcaaccgcttcaccatgacgcaccggcgcccgaccatcgagaaggacgtggacctgggcgccggcacccggcacgtcaacgcggagcccgagacccccaacatggacgtgatcggggagcgcatcaagcggatcaaggaggagcacaactccacgtggcactacgacgacgagaacccgtacaagacctgggcctaccacggcagctacgaggtgaaggccaccgggtccgccagcagcatgatcaacggcgtcgtgaagctgctcaccaagccctgggacgtcgtgcccatggtgacgcagatggccatgaccgacaccacccccttcgggcagcagcgcgtcttcaaggagaaggtggacacgcggaccccgcgctccatgcccggcacccggcgcgtgatgggcatcaccgcggagtggctgtggcggacgctggggcgcaacaagaagccccggctctgcacccgcgaggagttcaccaagaaggtccgcaccaacgccgccatgggcgccgtgttcacggaggagaaccagtgggacagcgcgaaggccgccgtggaggacgaggacttctggaagctggtcgaccgggagcgcgagctgcacaagctcgggaagtgcggctcctgcgtgtacaacatgatggggaagcgggagaagaagctgggcgagttcggcaaggccaaggggagccgcgccatctggtacatgtggctgggcgcgcggtacctcgagttcgaggccctggggttcctgaacgaggaccactggttctcccgcgagaacagctactccggcgtggagggggagggcctccacaagctgggctacatcctgcgggacatcagcaagatccccgggggcgccatgtacgccgacgacaccgccgggtgggacacccgcatcaccgaggacgacctccacaacgaggagaagatcacgcagcagatggacccggagcaccggcagctggcgaacgccatcttcaagctgacctaccagaacaaggtcgtgaaggtgcagcgccccacccccaccggcaccgtcatggacatcatctcccggaaggaccagcgcggcagcggccaggtgggcacgtacgggctcaacaccttcaccaacatggaggcccagctgatccggcagatggagggcgagggggtgctgtccaaggccgacctcgagaacccccacctcccggagaagaagatcacccagtggctggagacgaagggcgtcgagcgcctcaagcggatggccatcagcggcgacgactgcgtggtgaagcccatcgacgaccgcttcgcgaacgccctgctggccctcaacgacatggggaaggtccggaaggacatcccccagtggcagccctccaagggctggcacgactggcagcaggtcccgttctgcagccaccacttccacgagctgatcatgaaggacgggcgcaagctggtggtcccctgccggccccaggacgagctcatcggccgcgcccggatctcccagggggccggctggagcctgaaggagaccgcgtgcctgggcaaggcctacgcccagatgtggtccctcatgtacttccaccgccgcgacctgcggctggccagcaacgcgatctgctccgccgtgcccgtgcactgggtcccgaccagccgcaccacgtggagcatccacgcccaccaccagtggatgaccaccgaggacatgctcaccgtgtggaaccgggtgtggatcgaggacaacccctggatggaggacaagacgcccgtcaccacctgggagaacgtgccctacctggggaagcgcgaggaccagtggtgcggctccctgatcgggctcaccagccgggccacgtgggcccagaacatcccgaccgcgatccagcaggtccgctccctgatcggcaacgaggagttcctggactacatgcccagcatgaagcggttccgcaaggaggaggagtccgagggggccatctggtga

SEQ ID NO: 9997 - RNA, 9873 nt, synthetic construct
  misc_feature 1..9873: note = derived and/or modified CDS sequence (opt1) from DENV-3__FJ873813__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggtaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 9998 - RNA, 9873 nt, synthetic construct
  misc_feature 1..9873: note = derived and/or modified CDS sequence (opt1) from DENV-3__FJ850048__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 9999 - RNA, 9873 nt, synthetic construct
  misc_feature 1..9873: note = derived and/or modified CDS sequence (opt1) from DENV-3__FJ850049__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccgatgtgccagtccagctccatgcggaagaccgactggctccccatggcggtcgccgccatgggcgtgccgcccctcccgctgttcatcttcagcctcaaggacacgctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcaccgggacctccgccgacctgaccgtggagaaggccgcgaacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgcgggccgcaagagcatcgccctggacctggtcaccgagatcgggcgggtgccctcccacctcgcccaccgcacccggaacgccctggacaacctggtgatgctccacaccagcgagcacggcgggcgcgcctaccggcacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcgcacgccccaggacaaccagctggcctacgtggtgatcgggatcctcaccctggccgccatcatcgccgcgaacgagatgggcctgctcgagaccaccaagcgggacctgggcatgtccaaggagccgggggtcgtgagccccacgtcctacctggacgtggacctccaccccgccagcgcctggaccctgtacgccgtcgcgaccaccgtgatcacgcccatgctgcgccacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgggaggcccagaagcgcaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggacttcgacctctacaagaagtccggcatcaccgaggtcgaccggacggaggcgaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccggggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccacggtgatcgagcacctggagcggctccagcgcaagcacggcgggatgctggtccggaaccccctgtcccgcaacagcacccacgagatgtactggatctccaacggcaccgggaacatcgtggccagcgtgaacatggtctcccggctcctgctgaaccgcttcaccatgacgcaccggcgcccgaccatcgagaaggacgtggacctcggcgcgggcacccggcacgtgaacgccgagcccgagacccccaacatggacgtcatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtggtcaagctgctgaccaagccctgggacgtggtccccatggtgacgcagatggcgatgaccgacaccacccccttcgggcagcagcgcgtgttcaaggagaaggtcgacacgcggaccccgcgcagcatgcccggcacccggcgcgtgatgggcatcaccgccgagtggctctggcggacgctggggcgcaacaagaagccccggctgtgcacccgcgaggagttcaccaagaaggtgcgcaccaacgccgccatgggcgcggtcttcacggaggagaaccagtgggactccgccaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtcaaggtgcagcgccccacccccaccggcaccgtgatggacatcatcagccggaaggaccagcgcggctccgggcaggtcggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtggagcgcctgaagcggatggcgatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10000 - RNA, 9873 nt, synthetic construct
  misc_feature 1..9873: note = derived and/or modified CDS sequence (opt1) from DENV-3__FJ898476__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcaccatgacgcaccggcgcccgaccatcgagaaggacgtggacctcggcgcggggacccggcacgtcaacgccgagcccgagacccccaacatggacgtgatcggcgagcgcatcaagcggatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggcgatgaccgacaccacccccttcggccagcagcgcgtcttcaaggagaaggtggacacgcggaccccgcgcagcatgcccggcacccggcgcgtgatggggatcaccgccgagtggctctggcggacgctgggccgcaacaagaagccccggctgtgcacccgcgaggagttcaccaagaaggtccgcaccaacgccgccatgggggcggtgttcacggaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatctcccggaaggaccagcgcgggagcggccaggtggggacgtacggcctgaacaccttcaccaacatggaggcccagctcatccggcagatggagggggagggcgtgctgtccaaggccgacctggagaacccccacctcccggagaagaagatcacccagtggctggagacgaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgaccagccgggccacgtgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10001 - RNA, 9873 nt, synthetic construct
  misc_feature 1..9873: note = derived and/or modified CDS sequence (opt1) from DENV-3__FJ898475__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcctgaccttcgtcctcctgctgtccggccagatcacctggcgcgacatggcgcacacgctcatcatgatcggcagcaacgcctccgaccggatggggatgggcgtgacctacctggccctgatcgccaccttcaagatccagcccttcctcgccctggggttcttcctgcgcaagctcaccagccgggagaacctgctgctcggcgtgggcctggcgatggccacgaccctgcagctccccgaggacatcgagcagatggccaacgggatcgccctgggcctgatggcgctcaagctgatcacccagttcgagacctaccagctgtggacggccctcatcagcctgacctgctccaacaccatcttcaccctgacggtcgcctggcgcaccgccaccctcatcctggccggggtgagcctgctcccggtctgccagtccagctccatgcggaagaccgactggctgcccatggcggtggccgccatgggcgtgccgcccctgcccctgttcatcttcagcctgaaggacacgctgaagcgccgctcctggcccctcaacgagggggtcatggccgtgggcctggtgagcatcctggcctccagcctcctgcggaacgacgtccccatggcgggccccctggtggccgggggcctcctgatcgcctgctacgtgatcaccgggacctccgccgacctgaccgtcgagaaggccgcggacatcacgtgggaggaggaggccgagcagaccggcgtgagccacaacctcatgatcaccgtggacgacgacgggaccatgcgcatcaaggacgacgagaccgagaacatcctgacggtcctgctcaagaccgccctgctgatcgtgtccggcatcttcccgtacagcatccccgccaccctcctggtgtggcacacctggcagaagcagacgcagcggtccggcgtcctgtgggacgtgcccagcccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgcggtgctgacctacaacgggaagcgcctggagcccaactgggcctccgtcaagaaggacctcatcagctacggcgggggctggcggctgtccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctcgaggaggagatgttcaagaagcggaacctgaccatcatggacctgcaccccgggagcggcaagacgcgcaagtacctcccggccatcgtccgggaggcgatcaagcgccggctgcgcaccctgatcctcgcccccacccgggtggtggccgccgagatggaggaggccctgaaggggctgcccatccgctaccagaccacggcgaccaagtccgagcacaccggccgggagatcgtcgacctcatgtgccacgccaccttcacgatgcgcctgctgagccccgtgcgggtgccgaactacaacctcatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctgcggaagaacgggaagaaggtcatccagctgtcccgcaagacgttcgacaccgagtaccagaagaccaagctcaacgactgggacttcgtggtgaccacggacatcagcgagatgggcgccaacttcaaggccgaccgggtcatcgacccgcgccggtgcctgaagcccgtgatcctgaccgacggccccgagcgcgtgatcctcgccgggcccatgccggtcaccgcggcctccgccgcccagcggcgcggccgggtggggcgcaacccccagaaggagaacgaccagtacatcttcaccggccagcccctgaacaacgacgaggaccacgcccactggaccgaggcgaagatgctgctcgacaacatcaacacgcccgaggggatcatcccggccctgttcgagcccgagcgggagaagtccgccgccatcgacggcgagtaccgcctgaagggcgagtcccggaagaccttcgtggagctcatgcgccgcggggacctgcccgtctggctggcgcacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccggtggctggacgcccgcacgtactccgacccgctcgccctgaaggagttcaaggagttcgccgcgggccgcaagagcatcgccctggacctcgtgaccgagatcgggcgggtgccctcccacctggcccaccgcacccggaacgccctggacaacctcgtcatgctgcacaccagcgagcacggcgggcgcgcctaccggcacgcggtggaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggccgagatcccgctgcagtggatcgccagcgcgatcgtcctcgagttcttcatgatggtgctgctgatccccgagcccgagaagcagcgcacgccccaggacaaccagctcgcctacgtggtcatcgggatcctgaccctggccgccatcatcgccgcgaacgagatgggcctcctggagaccaccaagcgggacctgggcatgtccaaggagccgggggtggtgagccccacgtcctacctcgacgtcgacctgcaccccgccagcgcctggaccctgtacgccgtggcgaccaccgtgatcacgcccatgctccgccacaccatcgagaactccaccgccaacgtcagcctggccgccatcgccaaccaggcggtggtgctgatgggcctcgacaaggggtggccgatctccaagatggacctgggcgtccccctgctcgccctggggtgctacagccaggtgaaccccctgaccctcacggccgccgtgctgctgctcatcacccactacgccatcatcggccccggcctgcaggcgaaggccacccgggaggcccagaagcgcaccgccgccgggatcatgaagaacccgacggtcgacggcatcatgaccatcgacctggaccccgtgatctacgactccaagttcgagaagcagctcggccaggtgatgctgctggtcctctgcgcggtgcagctgctgctcatgcggaccagctgggccctgtgcgaggccctgaccctcgccacgggccccatcaccaccctgtgggagggctcccccgggaagttctggaacaccacgatcgcggtgagcatggccaacatcttccgcggctcctacctggccggggccggcctcgccttcagcatcatgaagtccgtcgggaccggcaagcggggcaccgggagccagggcgagaccctgggggagaagtggaagaagaagctgaaccagctcagccgcaaggacttcgacctgtacaagaagtccggcatcaccgaggtggaccggacggaggcgaaggaggggctgaagcgcggcgagatcacccaccacgccgtgagccggggctccgccaagctccagtggttcgtcgagcgcaacatggtgatcccggaggggcgggtgatcgacctgggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctcatgagcgggaaggacgtgttctacctgccgcccgagaagtgcgacaccctgctgtgcgacatcggcgagtccagcccctcccccaccgtggaggagagccgcaccatccgcgtcctcaagatggtggagccgtggctgaagaacaaccagttctgcatcaaggtgctgaacccctacatgcccacggtcatcgagcacctcgagcggctgcagcgcaagcacggcgggatgctggtgcggaaccccctctcccgcaacagcacccacgagatgtactggatctccaacggcaccgggaacatcgtggccagcgtcaacatggtgtcccggctgctgctcaaccgcttcaccatgacgcaccggcgcccgaccatcgagaaggacgtggacctgggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctcaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctgtggcggacgctggggcgcaacaagaagccccggctctgcacccgcgaggagttcaccaagaaggtccgcaccaacgccgccatgggcgcggtgttcacggaggagaaccagtgggactccgccaaggccgccgtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgcgatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgccatgtacgccgacgacaccgcggggtgggacacccgcatcaccgaggacgacctccacaacgaggagaagatcacgcagcagatggacccggagcaccggcagctggccaacgccatcttcaagctgacctaccagaacaaggtcgtgaaggtgcagcgccccacccccaccggcaccgtcatggacatcatcagccggaaggaccagcgcggctccggccaggtgggcacgtacgggctcaacaccttcaccaacatggaggcccagctgatccggcagatggagggcgagggggtgctgagcaaggccgacctcgagaacccccacctcccggagaagaagatcacccagtggctggagacgaagggcgtcgagcgcctcaagcggatggcgatctccggcgacgactgcgtggtgaagcccatcgacgaccgcttcgccaacgccctgctggccctcaacgacatggggaaggtccggaaggacatcccccagtggcagcccagcaagggctggcacgactggcagcaggtcccgttctgctcccaccacttccacgagctgatcatgaaggacgggcgcaagctggtggtcccctgccggccccaggacgagctcatcggccgcgcccggatcagccagggggcgggctggtccctgaaggagaccgcctgcctgggcaaggcctacgcccagatgtggagcctcatgtacttccaccgccgcgacctgcggctggcgtccaacgccatctgcagcgccgtgcccgtgcactgggtcccgacctcccgcaccacgtggagcatccacgcccaccaccagtggatgaccaccgaggacatgctcaccgtgtggaaccgggtgtggatcgaggacaacccctggatggaggacaagacgcccgtcaccacctgggagaacgtgccctacctggggaagcgcgaggaccagtggtgcggcagcctgatcgggctcacctcccgggccacgtgggcgcagaacatcccgaccgccatccagcaggtccgcagcctgatcggcaacgaggagttcctggactacatgccctccatgaagcggttccgcaaggaggaggagagcgagggggccatctggtga

SEQ ID NO: 10002 - RNA, 9873 nt, synthetic construct
  misc_feature 1..9873: note = derived and/or modified CDS sequence (opt1) from DENV-3__GQ199861__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccgatgtgccagtccagctccatgcggaagaccgactggctccccatggcggtcgccgccatgggcgtgccgcccctcccgctgttcatcttcagcctcaaggacacgctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcaccgggacctccgccgacctgaccgtggagaaggccgcggacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggccaacgtgaagaaggacctgatctcctacggcgggggctggcggctcagcgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggacctccggcagccccatcatcaaccgcgagggcaaggtcgtggggctgtacggcaacggggtggtcacgaagaacggcgggtacgtgagcggcatcgcccagaccaacgccgagccggacggccccacccccgagctggaggaggagatgttcaagaagcggaacctcaccatcatggacctgcaccccgggtccggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagagcgagcacaccggccgggagatcgtggacctgatgtgccacgccaccttcacgatgcgcctcctgtcccccgtccgggtgccgaactacaacctgatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtctggttcgtgccctccatcaaggcgggcaacgacatcgccaactgcctccggaagaacgggaagaaggtgatccagctgagccgcaagacgttcgacaccgagtaccagaagaccaagctgaacgactgggacttcgtcgtgaccacggacatctccgagatgggcgccaacttcaaggccgaccgggtgatcgacccgcgccggtgcctcaagcccgtcatcctgaccgacggccccgagcgcgtgatcctggccgggcccatgccggtgaccgcggccagcgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtggagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggagttcgccgcgggccgcaagtccatcgccctggacctggtcaccgagatcgggcgggtgcccagccacctcgcccaccgcacccggaacgccctggacaacctggtgatgctccacacctccgagcacggcgggcgcgcctaccggcacgcggtcgaggagctgcccgagacgatggagaccctgctcctgctgggcctcatgatcctgctgaccgggggcgccatgctgttcctgatcagcggcaaggggatcggcaagaccagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcgcacgccccaggacaaccagctggcctacgtggtgatcgggatcctcaccctggccgccatcatcgccgcgaacgagatgggcctgctcgagaccaccaagcgggacctgggcatgagcaaggagccgggggtcgtgtcccccacgagctacctggacgtggacctccaccccgcctccgcctggaccctgtacgccgtcgcgaccaccgtgatcacgcccatgctgcgccacaccatcgagaacagcaccgccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgaccctgacggccgccgtgctcctgctgatcacccactacgccatcatcggccccggcctccaggcgaaggccacccgggaggcccagaagcgcaccgccgccgggatcatgaagaacccgacggtggacggcatcatgaccatcgacctggaccccgtcatctacgacagcaagttcgagaagcagctgggccaggtgatgctcctggtgctgtgcgcggtccagctcctgctgatgcggacctcctgggccctctgcgaggccctgaccctggccacgggccccatcaccaccctctgggagggcagccccgggaagttctggaacaccacgatcgcggtgtccatggccaacatcttccgcggcagctacctggccggggccggcctggccttctccatcatgaagtccgtggggaccggcaagcggggcaccgggtcccagggcgagaccctcggggagaagtggaagaagaagctgaaccagctgagccgcaaggacttcgacctctacaagaagtccggcatcaccgaggtcgaccggacggaggcgaaggaggggctgaagcgcggcgagatcacccaccacgccgtgtcccggggcagcgccaagctgcagtggttcgtggagcgcaacatggtcatcccggaggggcgggtgatcgacctcggctgcgggcgcggcgggtggtcctactactgcgccggcctgaagaaggtgaccgaggtccggggctacaccaagggcgggcccgggcacgaggagcccgtgcccatgagcacgtacggctggaacatcgtgaagctgatgtccgggaaggacgtcttctacctcccgcccgagaagtgcgacaccctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccacggtgatcgagcacctggagcggctccagcgcaagcacggcgggatgctggtccggaaccccctgagccgcaactccacccacgagatgtactggatcagcaacggcaccgggaacatcgtggcctccgtgaacatggtcagccggctcctgctgaaccgcttcaccatgacgcaccggcgcccgaccatcgagaaggacgtggacctcggcgcgggcacccggcacgtgaacgccgagcccgagacccccaacatggacgtcatcggggagcgcatcaagcggatcaaggaggagcacaactccacgtggcactacgacgacgagaacccgtacaagacctgggcctaccacggcagctacgaggtgaaggccaccgggtccgccagctccatgatcaacggcgtggtcaagctgctgaccaagccctgggacgtggtccccatggtgacgcagatggcgatgaccgacaccacccccttcgggcagcagcgcgtgttcaaggagaaggtcgacacgcggaccccgcgcagcatgcccggcacccggcgcgtgatgggcatcaccgccgagtggctctggcggacgctggggcgcaacaagaagccccggctgtgcacccgcgaggagttcaccaagaaggtgcgcaccaacgccgccatgggcgcggtcttcacggaggagaaccagtgggacagcgccaaggccgccgtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtcaaggtgcagcgccccacccccaccggcaccgtgatggacatcatctcccggaaggaccagcgcggcagcgggcaggtcggcacgtacgggctgaacaccttcaccaacatggaggcccagctcatccggcagatggagggcgagggggtgctgtccaaggccgacctggagaacccccacctcccggagaagaagatcacccagtggctggagacgaagggcgtggagcgcctgaagcggatggcgatcagcggcgacgactgcgtcgtgaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtggtgccctgccggccccaggacgagctgatcggccgcgcccggatctcccagggggcgggctggagcctcaaggagaccgcctgcctgggcaaggcctacgcccagatgtggtccctgatgtacttccaccgccgcgacctccggctggcgagcaacgccatctgctccgccgtccccgtgcactgggtgccgaccagccgcaccacgtggtccatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgaccagccgggccacgtgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10003 - RNA, 9873 nt, synthetic construct
  misc_feature 1..9873: note = derived and/or modified CDS sequence (opt1) from DENV-3__GQ199862__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcctcgggaagacccaggtcggcgtgggggtgcagaaggagggcgtcttccacaccatgtggcacgtgacgcggggcgcggtgctgacctacaacgggaagcgcctggagcccaactgggcctccgtcaagaaggacctcatcagctacggcgggggctggcggctgtccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctcgaggaggagatgttcaagaagcggaacctgaccatcatggacctgcaccccgggagcggcaagacgcgcaagtacctcccggccatcgtccgggaggcgatcaagcgccggctgcgcaccctgatcctcgcccccacccgggtggtggccgccgagatggaggaggccctgaaggggctgcccatccgctaccagaccacggcgaccaagtccgagcacaccggccgggagatcgtcgacctcatgtgccacgccaccttcacgatgcgcctgctgagccccgtgcgggtgccgaactacaacctcatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctgcggaagaacgggaagaaggtcatccagctgtcccgcaagacgttcgacaccgagtaccagaagaccaagctcaacgactgggacttcgtggtgaccacggacatcagcgagatgggcgccaacttcaaggccgaccgggtcatcgacccgcgccggtgcctgaagcccgtgatcctgaccgacggccccgagcgcgtgatcctcgccgggcccatgccggtcaccgcggcctccgccgcccagcggcgcggccgggtggggcgcaacccccagaaggagaacgaccagtacatcttcaccggccagcccctgaacaacgacgaggaccacgcccactggaccgaggcgaagatgctgctcgacaacatcaacacgcccgaggggatcatcccggccctgttcgagcccgagcgggagaagtccgccgccatcgacggcgagtaccgcctgaagggcgagtcccggaagaccttcgtggagctcatgcgccgcggggacctgcccgtctggctggcgcacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccggtggctggacgcccgcacgtactccgacccgctcgccctgaaggagttcaaggagttcgccgcgggccgcaagagcatcgccctggacctcgtgaccgagatcgggcgggtgccctcccacctggcccaccgcacccggaacgccctggacaacctcgtcatgctgcacaccagcgagcacggcgggcgcgcctaccggcacgcggtggaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggccgagatcccgctgcagtggatcgccagcgcgatcgtcctcgagttcttcatgatggtgctgctgatccccgagcccgagaagcagcgcacgccccaggacaaccagctcgcctacgtggtcatcgggatcctgaccctggccgccatcatcgccgcgaacgagatgggcctcctggagaccaccaagcgggacctgggcatgtccaaggagccgggggtggtgagccccacgtcctacctcgacgtcgacctgcaccccgccagcgcctggaccctgtacgccgtggcgaccaccgtgatcacgcccatgctccgccacaccatcgagaactccaccgccaacgtcagcctggccgccatcgccaaccaggcggtggtgctgatgggcctcgacaaggggtggccgatctccaagatggacctgggcgtccccctgctcgccctggggtgctacagccaggtgaaccccctgaccctcacggccgccgtgctgctgctcatcacccactacgccatcatcggccccggcctgcaggcgaaggccacccgggaggcccagaagcgcaccgccgccgggatcatgaagaacccgacggtcgacggcatcatgaccatcgacctggaccccgtgatctacgactccaagttcgagaagcagctcggccaggtgatgctgctggtcctctgcgcggtgcagctgctgctcatgcggaccagctgggccctgtgcgaggccctgaccctcgccacgggccccgtgaccaccctgtgggagggctcccccgggaagttctggaacaccacgatcgcggtcagcatggccaacatcttccgcggctcctacctggccggggccggcctcgccttcagcatcatgaagtccgtggggaccggcaagcggggcaccgggagccagggcgagaccctgggggagaagtggaagaagaagctgaaccagctcagccgcaaggacttcgacctgtacaagaagtccggcatcaccgaggtggaccggacggaggcgaaggaggggctgaagcgcggcgagatcacccaccacgccgtcagccggggctccgccaagctccagtggttcgtggagcgcaacatggtgatcccggaggggcgggtcatcgacctgggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctcatgagcgggaaggacgtgttctacctgccgcccgagaagtgcgacaccctgctgtgcgacatcggcgagtccagcccctcccccaccgtcgaggagagccgcaccatccgcgtgctcaagatggtggagccgtggctgaagaacaaccagttctgcatcaaggtcctgaacccctacatgcccacggtgatcgagcacctcgagcggctgcagcgcaagcacggcgggatgctggtgcggaaccccctctcccgcaacagcacccacgagatgtactggatctccaacggcaccgggaacatcgtcgccagcgtgaacatggtgtcccggctgctgctcaaccgcttcaccatgacgcaccggcgcccgaccatcgagaaggacgtcgacctgggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctcaccaagccctgggacgtggtgcccatggtcacgcagatggcgatgaccgacaccacccccttcgggcagcagcgcgtgttcaaggagaaggtggacacgcggaccccgcgcagcatgcccggcacccggcgcgtcatgggcatcaccgccgagtggctgtggcggacgctggggcgcaacaagaagccccggctctgcacccgcgaggagttcaccaagaaggtgcgcaccaacgccgccatgggcgcggtgttcacggaggagaaccagtgggactccgccaaggccgccgtcgaggacgaggacttctggaagctggtggaccgggagcgcgagctgcacaagctcgggaagtgcggcagctgcgtgtacaacatgatggggaagcgggagaagaagctgggcgagttcggcaaggccaaggggtcccgcgcgatctggtacatgtggctgggcgcccggtacctcgagttcgaggccctggggttcctgaacgaggaccactggttcagccgcgagaactcctacagcggcgtcgagggggagggcctccacaagctgggctacatcctgcgggacatctccaagatccccgggggcgccatgtacgccgacgacaccgcggggtgggacacccgcatcaccgaggacgacctccacaacgaggagaagatcacgcagcagatggacccggagcaccggcagctggccaacgccatcttcaagctgacctaccagaacaaggtggtgaaggtccagcgccccacccccaccggcaccgtgatggacatcatcagccggaaggaccagcgcggctccggccaggtgggcacgtacgggctcaacaccttcaccaacatggaggcccagctgatccggcagatggagggcgagggggtcctgagcaaggccgacctcgagaacccccacctccccgagaagaagatcacccagtggctggagacgaagggcgtggagcgcctgaagcggatggcgatctccggcgacgactgcgtggtcaagcccatcgacgaccgcttcgccaacgccctgctggccctcaacgacatggggaaggtgcggaaggacatcccccagtggcagcccagcaagggctggcacgactggcagcaggtcccgttctgctcccaccacttccacgagctgatcatgaaggacgggcgcaagctggtcgtgccctgccggccccaggacgagctcatcggccgcgcccggatcagccagggggcgggctggtccctgaaggagaccgcctgcctgggcaaggcctacgcccagatgtggagcctcatgtacttccaccgccgcgacctgcggctggcgtccaacgccatctgcagcgccgtgcccgtccactgggtgccgacctcccgcaccacgtggagcatccacgcccaccaccagtggatgaccaccgaggacatgctcaccgtgtggaaccgggtctggatcgaggacaacccctggatggaggacaagacgcccgtgaccacctgggagaacgtgccctacctggggaagcgcgaggaccagtggtgcggcagcctgatcgggctcacctcccgggccacgtgggcgcagaacatcccgaccgccatccagcaggtccgcagcctgatcggcaacgaggagttcctggactacatgccctccatgaagcggttccgcaaggaggaggagagcgagggggccatctggtga

SEQ ID NO: 10004 - RNA, 9873 nt, synthetic construct
  misc_feature 1..9873: note = derived and/or modified CDS sequence (opt1) from DENV-3__GQ199863__SS-prME
  source 1..9873: mol_type = other RNA
accagcctctgcctcatgatgatcctgcccgcggcgctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggtcatcctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcccacaacggccgcctgatcaccgcgaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggccaccgcgcggggcgcccgccggatggccatcctgggcgacacggcctgggacttcgggtccgtgggcggggtcctcaacagcctgggcaagatggtgcaccagatcttcgggtccgcctacaccgcgctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggccgactcccccaagcgcctcgcgacggccatcgccggcgcctgggagaacggggtgtgcggcatccgcagcaccacccggatggagaacctgctgtggaagcagatcgccaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcgaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgccgcggtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggccgggcccatctcccagcacaaccaccggccgggctaccacacccagacggcggggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacacgctgatcatgatcggcagcaacgcgtccgaccggatggggatgggcgtgacctacctcgccctgatcgccaccttcaagatccagcccttcctggccctcgggttcttcctgcgcaagctgaccagccgggagaacctcctgctgggcgtcggcctcgccatggcgacgaccctgcagctgcccgaggacatcgagcagatggccaacgggatcgccctcggcctgatggccctgaagctcatcacccagttcgagacctaccagctgtggacggcgctgatcagcctgacctgctccaacaccatcttcaccctgacggtggcctggcgcaccgccaccctgatcctcgccggggtcagcctgctgccggtgtgccagtccagctccatgcggaagaccgactggctccccatggccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacatcacgtgggaggaggaggcggagcagaccggggtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtggtcgccgccgagatggaggaggccctcaaggggctgcccatccgctaccagaccacggccaccaagtccgagcacaccggccgggagatcgtggacctgatgtgccacgcgaccttcacgatgcgcctcctgagccccgtgcgggtcccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtgtggttcgtccccagcatcaaggccggcaacgacatcgcgaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgccgcgtccgccgcccagcggcgcggccgggtggggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcccacaaggtcgcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcatctactccgacccgctggccctcaaggagttcaaggagttcgccgccggccgcaagagcatcgcgctggacctggtgacggagatcgggcgggtcccctcccacctcgcccaccgcacccggaacgccctggacaacctggtgatgctccacaccagcgagcacggcgggcgcgcctaccggcacgccgtggaggagctgcccgagaccatggagacgctgctcctgctgggcctcatgatcctgctgaccgggggcgcgatgctgttcctgatcagcggcaaggggatcggcaagacctccatcgggctgatctgcgtcatcgccagctccggcatgctctggatggccgagatcccgctgcagtggatcgccagcgccatcgtgctggagttcttcatgatggtgctcctgatccccgagcccgagaagcagcgcacgccccaggacaaccagctggcgtacgtcgtgatcgggatcctcacgctggccgccatcatcgccgccaacgagatgggcctgctcgagaccaccaagcgggacctgggcatgtccaaggagccgggggtggtcagccccacctcctacctggacgtggacctccaccccgcgagcgcctggacgctgtacgccgtggccaccaccgtcatcacccccatgctgcgccacacgatcgagaactccaccgcgaacgtgagcctcgccgccatcgccaaccaggccgtggtcctgatgggcctggacaaggggtggccgatctccaagatggacctcggcgtgcccctgctggcgctcgggtgctacagccaggtgaaccccctgaccctgaccgccgccgtcctcctgctgatcacgcactacgccatcatcggccccggcctccaggccaaggcgacccgggaggcccagaagcgcaccgccgccgggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcggaccagctgggcgctctgcgaggccctgaccctggccaccggccccatcacgaccctctgggagggctcccccgggaagttctggaacaccaccatcgccgtcagcatggcgaacatcttccgcggctcctacctggccggggccggcctggccttcagcatcatgaagtccgtggggacgggcaagcggggcaccgggagccagggcgagaccctcggggagaagtggaagaagaagctgaaccagctgagccgcaaggacttcgacctctacaagaagtccggcatcaccgaggtggaccggaccgaggccaaggaggggctgaagcgcggcgagatcacgcaccacgcggtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgtcccgcaacagcacgcacgagatgtactggatctccaacggcaccgggaacatcgtcgccagcgtgaacatggtgtcccggctcctgctgaaccgcttcaccatgacccaccggcgcccgacgatcgagaaggacgtcgacctcggcgccggcacccggcacgtgaacgcggagcccgagacccccaacatggacgtgatcggggagcgcatcaagcggatcaaggaggagcacaacagcacctggcactacgacgacgagaacccgtacaagacgtgggcctaccacggctcctacgaggtcaaggccaccgggagcgcctccagcatgatcaacggcgtggtcaagctgctgaccaagccctgggacgtggtgcccatggtcacccagatggccatgacggacaccacccccttcgggcagcagcgcgtgttcaaggagaaggtggacacccggacgccgcgcagcatgcccggcacccggcgcgtcatgggcatcaccgcggagtggctctggcggaccctggggcgcaacaagaagccccggctgtgcacgcgcgaggagttcaccaagaaggtgcgcaccaacgccgccatgggcgccgtgttcaccgaggagaaccagtgggactccgcgaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacacggccgggtgggacacccgcatcaccgaggacgacctgcacaacgaggagaagatcacccagcagatggacccggagcaccggcagctcgcgaacgccatcttcaagctgacgtaccagaacaaggtggtgaaggtccagcgccccacccccaccggcaccgtgatggacatcatcagccggaaggaccagcgcggctccggccaggtgggcacctacgggctgaacacgttcaccaacatggaggcccagctcatccggcagatggagggcgagggggtcctgagcaaggccgacctggagaacccccacctcccggagaagaagatcacccagtggctggagaccaagggcgtggagcgcctgaagcggatggccatctccggcgacgactgcgtggtcaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggccggctggtccctcaaggagacggcgtgcctgggcaaggcctacgcccagatgtggagcctgatgtacttccaccgccgcgacctccggctggcctccaacgcgatctgcagcgccgtgcccgtccactgggtgccgacctcccgcaccacctggagcatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggcagcctgatcgggctgacctcccgggccacctgggcccagaacatcccgacggcgatccagcaggtccgcagcctcatcggcaacgaggagttcctggactacatgccctccatgaagcggttccgcaaggaggaggagagcgagggggccatctggtga

SEQ ID NO: 10005 - RNA, 9873 nt, synthetic construct
  misc_feature 1..9873: note = derived and/or modified CDS sequence (opt1) from DENV-3__GQ199864__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctgaacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatcggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10006 - RNA, 9873 nt, synthetic construct
  misc_feature 1..9873: note = derived and/or modified CDS sequence (opt1) from DENV-3__GQ199865__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccgatgtgccagtccagctccatgcggaagaccgactggctccccatggcggtcgccgccatgggcgtgccgcccctcccgctgttcatcttcagcctcaaggacacgctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcaccgggacctccgccgacctgaccgtggagaaggccgcggacatcacgtggggcgaggaggccgagcagaccggggtcagccacatgctgatgatcaccgtggaggacgacggcaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggggtgctgtgggacgtccccagcccgcccgagacccagaaggccgagctggaggagggcgtgtaccgcatcaagcagcaggggatcttcggcaagacccaggtgggggtcggcgtgcagaaggagggcgtgttccacaccatgtggcacgtcacgcgcggggcggtgctcacctacaacggcaagcgcctggagcccaactgggcctccgtgaagaaggacctgatcagctacgggggcgggtggcggctctccgcccagtggcagaagggcgaggaggtccaggtgatcgccgtggagcccggcaagaaccccaagaacttccagaccatgcccgggaccttccagacgaccaccggcgagatcggggcgatcgccctggacttcaagcccggcaccagcggcagccccatcatcaaccgcgaggggaaggtcgtgggcctgtacgggaacggcgtggtcacgaagaacgggggctacgtgtccggcatcgcccagaccaacgccgagccggacgggcccacccccgagctggaggaggagatgttcaagaagcggaacctcaccatcatggacctgcaccccggcagcgggaagacgcgcaagtacctgccggccatcgtgcgggaggcgatcaagcgccggctccgcaccctgatcctggcccccacccgggtcgtggccgccgagatggaggaggccctcaagggcctgcccatccgctaccagaccacggcgaccaagtccgagcacaccgggcgggagatcgtggacctgatgtgccacgccaccttcacgatgcgcctcctgagccccgtccgggtgccgaactacaacctgatcatcatggacgaggcccacttcaccgaccccgcctccatcgccgcgcgcggctacatcagcacccgggtgggcatgggggaggccgccgccatcttcatgaccgcgacgccgcccggcaccgccgacgccttcccgcagtccaacgcccccatccaggacgaggagcgcgacatccccgagcgcagctggaactccgggaacgagtggatcaccgacttcgccggcaagaccgtctggttcgtgcccagcatcaaggcggggaacgacatcgccaactgcctccggaagaacggcaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacgggcccgagcgcgtgatcctggccggccccatgccggtgaccgcggcctccgccgcccagcggcgcgggcgggtcggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagtcccggaagaccttcgtggagctgatgcgccggggcgacctccccgtgtggctggcgcacaaggtcgccagcgaggggatcaagtacaccgaccgcaagtggtgcttcgacggccagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgcggggcgcaagagcatcgccctggacctggtcaccgagatcggccgggtgccctcccacctcgcccaccgcacccggaacgccctggacaacctggtgatgctccacaccagcgagcacgggggccgcgcctaccggcacgcggtcgaggagctgcccgagacgatggagaccctgctcctgctggggctcatgatcctgctgaccggcggcgccatgctgttcctgatcagcgggaagggcatcgggaagacctccatcggcctgatctgcgtgatcgccagctccgggatgctctggatggccgagatcccgctgcagtggatcgccagcgcgatcgtgctggagttcttcatgatggtcctcctgatccccgagcccgagaagcagcgcacgccccaggacaaccagctggcctacgtggtgatcggcatcctcaccctggccgccatcatcgccgcgaacgagatgggcctgctcgagaccaccaagcgggacctggggatgtccaaggagccgggcgtcgtgagccccacgtcctacctggacgtggacctccaccccgccagcgcctggaccctgtacgccgtcgcgaccaccgtgatcacgcccatgctgcgccacaccatcgagaactccaccgccaacgtgagcctcgccgccatcgccaaccaggcggtcgtgctgatggggctggacaagggctggccgatctccaagatggacctcggggtgcccctgctggccctcggctgctacagccaggtcaaccccctgaccctgacggccgccgtgctcctgctgatcacccactacgccatcatcggccccgggctccaggcgaaggccacccgggaggcccagaagcgcaccgccgccggcatcatgaagaacccgacggtggacgggatcatgaccatcgacctggaccccgtcatctacgactccaagttcgagaagcagctgggccaggtgatgctcctggtgctgtgcgcggtccagctcctgctgatgcggaccagctgggccctctgcgaggccctgaccctggccacgggccccatcaccaccctctgggaggggtcccccggcaagttctggaacaccacgatcgcggtgagcatggccaacatcttccgcgggtcctacctggccggcgccgggctggccttcagcatcatgaagtccgtgggcaccggcaagcgggggaccggcagccagggggagaccctcggcgagaagtggaagaagaagctgaaccagctgagccgcaaggacttcgacctctacaagaagtccgggatcaccgaggtcgaccggacggaggcgaaggagggcctgaagcgcggcgagatcacccaccacgccgtgagccgggggtccgccaagctgcagtggttcgtggagcgcaacatggtcatcccggagggccgggtgatcgacctcgggtgcggccgcgggggctggagctactactgcgccggcctgaagaaggtgaccgaggtccgggggtacaccaagggcgggcccggccacgaggagcccgtgcccatgtccacgtacgggtggaacatcgtgaagctgatgagcggcaaggacgtcttctacctcccgcccgagaagtgcgacaccctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccacggtgatcgagcacctggagcggctccagcgcaagcacgggggcatgctggtccggaaccccctgtcccgcaacagcacccacgagatgtactggatctccaacgggaccggcaacatcgtggccagcgtgaacatggtctcccggctcctgctgaaccgcttcaccatgacgcaccggcgcccgaccatcgagaaggacgtggacctcggcgcggggacccggcacgtgaacgccgagcccgagacccccaacatggacgtcatcggcgagcgcatcaagcggatcaaggaggagcacaacagcacgtggcactacgacgacgagaacccgtacaagacctgggcctaccacgggtcctacgaggtgaaggccaccggcagcgcctccagcatgatcaacggggtggtcaagctgctgaccaagccctgggacgtggtccccatggtgacgcagatggcgatgaccgacaccacccccttcggccagcagcgcgtgttcaaggagaaggtcgacacgcggaccccgcgcagcatgcccggcacccggcgcgtgatggggatcaccgccgagtggctctggcggacgctgggccgcaacaagaagccccggctgtgcacccgcgaggagttcaccaagaaggtgcgcaccaacgccgccatgggggcggtcttcacggaggagaaccagtgggactccgccaaggccgccgtggaggacgaggacttctggaagctcgtggaccgggagcgcgagctgcacaagctgggcaagtgcgggagctgcgtctacaacatgatgggcaagcgggagaagaagctcggcgagttcgggaaggccaagggctcccgcgcgatctggtacatgtggctgggggcccggtacctggagttcgaggccctcggcttcctgaacgaggaccactggttcagccgcgagaactcctacagcggggtggagggcgagggcctgcacaagctcgggtacatcctgcgggacatctccaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtggtcaaggtgcagcgccccacccccaccggcaccgtgatggacatcatcagccggaaggaccagcgcgggtccggccaggtcgggacgtacggcctgaacaccttcaccaacatggaggcccagctcatccggcagatggagggggagggcgtgctgagcaaggccgacctggagaacccccacctcccggagaagaagatcacccagtggctggagacgaagggcgtggagcgcctgaagcggatggcgatctccggggacgactgcgtcgtgaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtggtgccctgccggccccaggacgagctgatcgggcgcgcccggatcagccagggcgcgggctggtccctcaaggagaccgcctgcctggggaaggcctacgcccagatgtggagcctgatgtacttccaccgccgcgacctccggctggcgtccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcggcaagcgcgaggaccagtggtgcgggagcctgatcggcctgacctcccgggccacgtgggcgcagaacatcccgaccgccatccagcaggtccgcagcctcatcgggaacgaggagttcctggactacatgccctccatgaagcggttccgcaaggaggaggagagcgagggcgccatctggtga

SEQ ID NO: 10007 - RNA, 9873 nt, synthetic construct
  misc_feature 1..9873: note = derived and/or modified CDS sequence (opt1) from DENV-3__GQ199870__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgagctggatctccaacgggaccggcaacatcgtggccagcgtcaacatggtgtcccggctcctgctgaaccgcagcaccatgacgcaccggcgcccgaccatcgagaaggacgtggacctcggcgcggggccccggcacgtcaacgccgaccccgagccgcccaacatggacgtgatcggcgagcgcatcaagcgggtgaaggaggagcacaactccacctggcactacgacgacgagaacccctacaagacctgggcctaccacgggagctacgaggtcaaggccacgggctccgccagcagcatgatcaacggggtggtcaagctgctgaccaagccctgggacgtggtgccgatggtcccccagatggcgatgaccgacaccacgcccttcggccagcagcgcgtgttcaaggagaaggtggacacccggacgccccggtccatcccgggcacccggcgcgtcatggggatcacggccgagtggctctggcggaccctgggccgcaacaagaagccccggctgtgcacccgcgaggagttcaccaagaaggtgcgcacgaacgccgccatgggggcggtgttcaccgaggagaaccagtgggacagcgccaaggccgccgtcgaggacgaggacttctggaagctcgtggaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtcgagggcgagggcctgcacaagctcgggtacatcctgcgggacatcagcaagatccccggcggggccatgtacgccgacgacaccgcgggctgggacacccgcatcacggaggacgacctgcacaacgaggagaagatcacccagcagatggaccccgagcaccggcagctcgccaacgccatcttcaagctgacctaccagaacaaggtggtgaaggtccagcgcccgacccccacgggcaccgtgatggacatcatctcccggaaggaccagcgcgggagcggccaggtggggacctacggcctgaacaccttcaccaacatggaggcccagctcatccggcagatggagggggagggcgtcctgtccaaggccgacctggagaacccccacctccccgagaagaagatcacgcagtggctggagaccaagggcgtggagcgcctgaagcggatggcgatcagcggggacgactgcgtggtcaagccgatcgacgaccgcttcgccaacgccctcctggccctgaacgacatgggcaaggtgcggaaggacatcccccagtggcagccctccaaggggtggcacgactggcagcaggtccccttctgcagccaccacttccacgagctcatcatgaaggacggccgcaagctggtcgtgccgtgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtccactgggtgcccaccagccgcacgacctggagcatccacgcccaccaccagtggatgaccaccgaggacatgctgacggtgtggaaccgggtctggatcgaggacaacccgtggatggaggacaagacccccgtgaccacctgggagaacgtgccctacctcggcaagcgcgaggaccagtggtgcgggtccctgatcggcctgacgagccgggccacctgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10008 - RNA, 9873 nt, synthetic construct
  misc_feature 1..9873: note = derived and/or modified CDS sequence (opt1) from DENV-3__JF937630__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacgcgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggagttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgtccaaggagccgggggtggtgagccccacctcctacctggacgtcgacctccaccccgccagcgcctggacgctgtacgcggtggccaccaccgtgatcacccccatgctgcgccacacgatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtcgggacgggcaagcggggcaccgggagccagggcgagaccctcggggagaagtggaagaagaagctgaaccagctgagccgcaaggacttcgacctctacaagaagtccggcatcaccgaggtggaccggaccgaggccaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggcgagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgccgagtggctctggcggaccctggggcgcaacaagaagccccggctgtgcacgcgcgaggagttcaccaagaaggtccgcaccaacgccgcgatgggcgccgtgttcaccgaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggcggacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcgcggatcagccagggggccggctggtccctcaaggagacggcctgcctgggcaaggcctacgcgcagatgtggagcctgatgtacttccaccgccgcgacctccggctggcctccaacgccatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggcgacctgggcccagaacatcccgacggccatccagcaggtccgcagcctcatcggcaacgaggagttcctggactacatgccctccatgaagcggttccgcaaggaggaggagagcgagggggccatctggtga

SEQ ID NO: 10009 - RNA, 9873 nt, synthetic construct
  misc_feature 1..9873: note = derived and/or modified CDS sequence (opt1) from DENV-3__JN000936__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtggtcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtggcctggcgcacggccaccctgatcctcgccggggtcagcctgctgccgatgtgccagtccagctccatgcggaagaccgactggctccccatggcggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcacggggacctccgccgacctgaccgtcgagaaggccgcggacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgcggtgctcacgtacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagaccacgaccggggagatcggcgcgatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtccgggaggcgatcaagcgccggctccgcacgctgatcctggcccccacccgggtggtggccgccgagatggaggaggccctcaaggggctgcccatccgctaccagaccaccgcgacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgccgcgcgcgggtacatcagcacccgggtcggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggagttcgccgcgggccgcaagagcatcgccctggacctggtgacggagatcgggcgggtgccctcccacctcgcccaccgcacccggaacgccctggacaacctggtcatgctccacaccagcgagcacggcgggcgcgcctaccggcacgcggtggaggagctgcccgagaccatggagacgctgctcctgctgggcctcatgatcctgctgaccgggggcgccatgctgttcctgatcagcggcaaggggatcggcaagacctccatcgggctgatctgcgtgatcaccagctccggcatgctctggatggccgagatcccgctgcagtggatcgccagcgccatcgtcctggagttcttcatgatggtgctcctgatccccgagcccgagaagcagcgcacgccccaggacaaccagctggcgtacgtggtcatcgggatcctcaccctggccgccatcatcgccgccaacgagatgggcctgctcgagaccaccaagcgggacctgggcatgtccaaggagccgggggtggtgagccccacgtcctacctggacgtcgacctccaccccgcgagcgcctggaccctgtacgccgtggccaccaccgtgatcacgcccatgctgcgccacaccatcgagaactccaccgcgaacgtcagcctcgccgccatcgccaaccaggccgtggtgctgatgggcctggacaaggggtggccgatctccaagatggacctcggcgtccccctgctggcgctcgggtgctacagccaggtgaaccccctgaccctgacggccgccgtgctcctgctgatcacccactacgccatcatcggccccggcctccaggccaaggcgacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgccgtgcagctcctgctgatgcggaccagctgggcgctctgcgaggccctgaccctggccacgggccccatcaccaccctctgggagggctcccccgggaagttctggaacaccacgatcgccgtgagcatggcgaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggccaaggaggggctgaagcgcggcgagatcacccaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgccggcacccggcacgtcaacgcggagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgcggagtggctctggcggacgctggggcgcaacaagaagccccggctgtgcacccgcgaggagttcaccaagaaggtccgcaccaacgccgccatgggcgccgtgttcacggaggagaaccagtgggactccgcgaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgccgggtgggacacccgcatcaccgaggacgacctgcacaacgaggagaagatcacgcagcagatggacccggagcaccggcagctcgcgaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggccatctccggcgacgactgcgtggtgaagcccatcgacgaccgcttcgcgaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctcaaggagaccgcgtgcctgggcaaggcctacgcccagatgtggagcctgatgtacttccaccgccgcgacctccggctggcctccaacgcgatctgcagcgccgtgcccgtgcactgggtcccgacctcccgcaccacgtggagcatccacgcccaccaccagtggatgaccaccgacgacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10010 - RNA, 9873 nt, synthetic construct
  misc_feature 1..9873: note = derived and/or modified CDS sequence (opt1) from DENV-3__HQ541796__SS-prME
  source 1..9873: mol_type = other RNA
accagcctctgcctcatgatgatcctgcccgccgccctggcgttccacctcaccagccgggacggcgagccgcggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacaccgtcatcggcatcggggacaacgccctgaagatcaactggtacaagaagggctccagcatcgggaagatgttcgaggcgacggcccggggcgcccgccggatggccatcctgggcgacaccgcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggccgacatggggtgcgtcatcaactggaagggcaaggagctgaagtgcggcagcgggatcttcgtgaccaacgaggtgcacacctggacggagcagtacaagttccaggcggactcccccaagcgcctcgccaccgccatcgccggcgcctgggagaacggggtctgcggcatccgcagcaccacccggatggagaacctgctgtggaagcagatcgcgaacgagctcaactacatcctgtgggagaacaacatcaagctgacggtggtggtcggggacatcatcggcgtgctcgagcagggcaagcgcaccctgacgccccagccgatggagctgaagtactcctggaagacctgggggaaggccaagatcgtgacggccgagacccagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacgcagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacgtggcgcgacatggcgcacaccctgatcatgatcggcagcaacgcctccgaccggatggggatgggcgtgacctacctcgccctgatcgccaccttcaagatccagcccttcctggccctcgggttcttcctgcgcaagctgacgagccgggagaacctcctgctgggcgtgggcctcgcgatggccaccaccctgcagctgcccgaggacatcgagcagatggccaacgggatcgccctcggcctgatggcgctgaagctcatcacccagttcgagacgtaccagctgtggaccgccctgatcagcctgacctgctccaacaccatcttcacgctgaccgtcgcctggcgcaccgccaccctgatcctcgccggggtgagcctgctgccggtctgccagtccagctccatgcggaagacggactggctccccatggcggtggccgccatgggcgtgccgcccctcccgctgttcatcttcgggctcaaggacaccctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgacggtcgagaaggccgcggacatcacctgggaggaggaggccgagcagaccggggtgtcccacaacctgatgatcaccgtggacgacgacggcaccatgcgcatcaaggacgacgagacggagaacatcctcaccgtcctgctgaagaccgccctcctgatcgtgagcggcatcttcccgtactccatccccgccaccctgctcgtgtggcacacgtggcagaagcagacccagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacacgatgtggcacgtgacccgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggacgttccagaccaccaccggcgagatcggggcgatcgccctggacttcaagcccggcacgtccggcagccccatcatcaaccgcgaggggaaggtggtgggcctgtacgggaacggcgtcgtgaccaagaacgggggctacgtgagcggcatcgcccagaccaacgccgagccggacgggcccacccccgagctggaggaggagatgttcaagaagcggaacctcacgatcatggacctgcaccccggctccgggaagacccgcaagtacctgccggccatcgtccgggaggcgatcaagcgccggctccgcaccctgatcctggcccccacccgggtggtggccgccgagatggaggaggccctcaagggcctgcccatccgctaccagacgaccgcgaccaagagcgagcacaccgggcgggagatcgtcgacctgatgtgccacgccacgttcaccatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgacggcgacgccgcccggcaccgccgacgccttcccgcagagcaacgcccccatccaggacgaggagcgcgacatccccgagcgctcctggaacagcgggaacgagtggatcaccgacttcgccggcaagacggtgtggttcgtgccctccatcaaggcggggaacgacatcgccaactgcctccggaagaacggcaagaaggtcatccagctgagccgcaagaccttcgacaccgagtaccagaagaccaagctgaacgactgggacttcgtggtgacgaccgacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggacggaggcgaagatgctgctggacaacatcaacacccccgagggcatcatcccggccctcttcgagcccgagcgggagaagtccgccgccatcgacggcgagtaccgcctgaagggggagagccggaagaccttcgtggagctgatgcgccggggcgacctcaccgtctggctggcgcacaaggtggcctccgaggggatcaagtacacggaccgcaagtggtgcttcgacggccagcggaacaaccagatcctggaggagaacatggacgtcgagatctggaccaaggagggcgagaagaagaagctccgcccccggtggctggacgcccgcacctacagcgaccccctggccctcaaggagttcaaggagttcgccgcggggcgcaagtccatcgccctggacctggtgaccgagatcggccgggtgccgagccacctcgcccaccgcacgcggaacgccctggacaacctggtcatgctccacacctccgagcacgggggccgcgcctaccggcacgcggtggaggagctgcccgagaccatggagaccctgctcctgctggggctcatgatcctgctgacgggcggcgccatgctgttcctgatcagcgggaagggcatcgggaagaccagcatcggcctgatctgcgtgatcgcctccagcgggatgctctggatggccgagatccccctgcagtggatcgcctccgcgatcgtcctggagttcttcatgatggtgctcctgatcccggagcccgagaagcagcgcacgccccaggacaaccagctggcctacgtggtcatcggcatcctcaccctggccgccatcatcgccgcgaacgagatgggcctgctcgagacgaccaagcgggacctggggatgagcaaggagcccggcgtggtgtccccgaccagctacctggacgtcgacctccaccccgcctccgcctggaccctgtacgccgtggcgacgaccgtgatcacccccatgctgcgccacaccatcgagaacagcacggccaacgtctccctcgccgccatcgccaaccaggcggtggtgctgatggggctggacaagggctggcccatcagcaagatggacctcggggtcccgctgctggccctcggctgctactcccaggtgaaccccctgaccctgaccgccgccgtgctcctgctgatcacccactacgccatcatcggccccgggctccaggcgaaggccacgcgggaggcccagaagcgcaccgccgccggcatcatgaagaaccccaccgtcgacgggatcatgaccatcgacctggacccggtgatctacgacagcaagttcgagaagcagctgggccaggtgatgctcctggtcctgtgcgcggtgcagctcctgctgatgcggacgtcctgggccctctgcgaggccctgaccctggccaccggccccatcaccacgctctgggaggggagccccggcaagttctggaacaccaccatcgcggtgtccatggccaacatcttccgcgggagctacctggccggcgccgggctggccttctccatcatgaagtccgtcggcaccggcaagcgggggaccggctcccagggggagacgctcggcgagaagtggaagaagaagctgaaccagctgagccgcaaggacttcgacctctacaagaagtccgggatcaccgaggtggaccggaccgaggcgaaggagggcctgaagcgcggcgagatcacccaccacgccgtgtcccgggggagcgccaagctgcagtggttcgtcgagcgcaacatggtgatccccgagggccgggtgatcgacctcgggtgcggccgcgggggctggtcctactactgcgccggcctgaagaaggtcacggaggtgcgggggtacaccaagggcgggccgggccacgaggagcccgtgcccatgagcacctacgggtggaacatcgtcaagctgatgtccggcaaggacgtgttctacctcccgcccgagaagtgcgacaccctgctgtgcgacatcggcgagagctcccccagccccacggtggaggagtcccgcaccatccgcgtcctgaagatggtggagccctggctcaagaacaaccagttctgcatcaaggtgctgaacccctacatgcccaccgtcatcgagcacctggagcggctccagcgcaagcacgggggcatgctggtgcggaaccccctgagccgcaactccacccacgagatgtactggatcagcaacgggacgggcaacatcgtggcctccgtcaacatggtgagccggctcctgctgaaccgcttcaccatgacccaccggcgccccaccatcgagaaggacgtggacctcggcgcggggacgcggcacgtcaacgccgagccggagacccccaacatggacgtgatcggcgagcgcatcaagcggatcaaggaggagcacaactccacctggcactacgacgacgagaacccctacaagacctgggcctaccacgggagctacgaggtgaaggccacgggctccgccagctccatgatcaacggggtcgtgaagctgctgaccaagccgtgggacgtcgtgcccatggtgacccagatggcgatgaccgacacgacccccttcggccagcagcgcgtcttcaaggagaaggtggacacccggacgccccggagcatgccgggcacgcggcgcgtgatggggatcaccgccgagtggctctggcggaccctgggccgcaacaagaagccccggctgtgcacccgcgaggagttcacgaagaaggtccgcaccaacgccgccatgggggcggtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacgcgcatcaccgaggacgacctgcacaacgaggagaagatcacccagcagatggaccccgagcaccggcagctcgccaacgccatcttcaagctgacctaccagaacaaggtcgtgaaggtgcagcgcccgacccccacgggcaccgtcatggacatcatctcccggaaggaccagcgcgggagcggccaggtggggacctacggcctgaacaccttcacgaacatggaggcccagctcatccggcagatggagggggagggcgtgctgtccaaggccgacctggagaacccccacctccccgagaagaagatcacccagtggctggagaccaagggcgtcgagcgcctgaagcggatggcgatcagcggggacgactgcgtggtgaagccgatcgacgaccgcttcgccaacgccctcctggccctgaacgacatgggcaaggtccggaaggacatcccccagtggcagccctccaaggggtggcacgactggcagcaggtccccttctgcagccaccacttccacgagctcatcatgaaggacggccgcaagctggtggtcccgtgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtgcactgggtccccacgagccgcaccacctggtccatccacgcccaccaccagtggatgaccacggaggacatgctgaccgtgtggaaccgggtgtggatcgaggacaacccgtggatggaggacaagacccccgtcaccacgtgggagaacgtgccctacctcggcaagcgcgaggaccagtggtgcgggagcctgatcggcctgaccagccgggccacctgggcgcagaacatccccaccgccatccagcaggtccgctccctcatcgggaacgaggagttcctggactacatgccgagcatgaagcggttccgcaaggaggaggagtccgagggcgccatctggtga

SEQ ID NO: 10011 - RNA, 9873 nt, synthetic construct
  misc_feature 1..9873: note = derived and/or modified CDS sequence (opt1) from DENV-3__HQ166034__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcgcacggccaccctgatcctcgccggggtgagcctgctgccgatgtgccagtccagctccatgcggaagaccgactggctccccatggcggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtgcgggaggcgatcaagcgccggctccgcacgctgatcctggcccccacccgggtcgtggccgccgagatggaggaggccctcaaggggctgcccatccgctaccagaccaccgcgacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgccgcgcgcgggtacatcagcacccgggtgggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggagttcgccgcgggccgcaagagcatcgccctggacctggtcacggagatcgggcgggtgccctcccacctcgcccaccgcacccggaacgccctggacaacctggtgatgctccacaccagcgagcacggcgggcgcgcctaccggcacgcggtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcgcacgccccaggacaaccagctggcctacgtggtgatcgggatcctcacgctggccgccatcatcgccgcgaacgagatgggcctgctcgagaccaccaagcgggacctgggcatgtccaaggagccgggggtcgtgagccccacctcctacctggacgtggacctccaccccgccagcgcctggacgctgtacgccgtcgcgaccaccgtgatcacccccatgctgcgccacacgatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgccatcatcggccccggcctccaggcgaaggccacccgggaggcccagaagcgcaccgccgccgggatcatgaagaacccgaccgtggacggcatcatgacgatcgacctggaccccgtcatctacgactccaagttcgagaagcagctgggccaggtgatgctcctggtgctgtgcgtcgtgcagctcctgctgatgcggaccagctgggcgctctgcgaggccctgaccctggccaccggccccatcacgaccctctgggagggctcccccgggaagttctggaacaccaccatcgccgtgagcatggcgaacatcttccgcggctcctacctggccggggccggcctggccttcagcatcatgaagtccgtcgggacgggcaagcggggcaccgggagccagggcgagaccctcggggagaagtggaagaagaagctgaaccagctgagccgcaaggacttcgacctctacaagaagtccggcatcaccgaggtggaccggaccgaggccaaggaggggctgaagcgcggcgagatcacgcaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgcggagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgcggagtggctctggcggaccctggggcgcaacaagaagccccggctgtgcacgcgcgaggagttcaccaagaaggtccgcaccaacgccgccatgggcgccgtgttcaccgaggagaaccagtgggactccgcgaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccggggccgccatgtacgccgacgacacggcgggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccgggaccgtcatggacatcatcagccggaaggaccagcgcggctccggccaggtggggacctacggcctgaacacgttcaccaacatggaggcccagctcatccggcagatggagggggagggcgtgctgagcaaggccgacctggagaacccccacctcccggagaagaagatcacccagtggctggagaccaagggggtcgagcgcctgaagcggatggcgatctccggcgacgactgcgtggtgaagcccatcgacgaccgcttcgccaacgccctcctggccctgaacgacatgggcaaggtccggaaggacatcccccagtggcagcccagcaaggggtggcacgactggcagcaggtcccgttctgctcccaccacttccacgagctcatcatgaaggacggccgcaagctggtggtcccctgccggccccaggacgagctgatcgggcgcgcccggatcagccagggcgcggggtggtccctcaaggagacggcctgcctgggcaaggcctacgcccagatgtggagcctgatgtacttccaccgccgcgacctccggctggcgtccaacgccatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcggcaagcgcgaggaccagtggtgcgggagcctgatcggcctgacctcccgggccacctgggcgcagaacatcccgacggccatccagcaggtccgcagcctcatcgggaacgaggagttcctggactacatgccctccatgaagcggttccgcaaggaggaggagagcgagggcgccatctggtga

SEQ ID NO: 10012 - RNA, 9873 nt, synthetic construct
  misc_feature 1..9873: note = derived and/or modified CDS sequence (opt1) from DENV-3__HM756274__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacgcgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcgggctcaaggacaccctgaagcgccgcagctggcccctgaacgagggcgtcatggccgtgggcctcgtgtccatcctggcgagctccctgctccggaacgacgtccccatggccgggcccctggtggccggcgggctgctcatcgcctgctacgtgatcacgggcaccagcgccgacctgaccgtcgagaaggcggccgacatcacctgggaggaggaggccgagcagacgggggtgtcccacaacctgatgatcaccgtggacgacgacggcaccatgcgcatcaaggacgacgagaccgagaacatcctcaccgtcctgctgaagacggccctcctgatcgtgagcggcatcttcccgtactccatccccgccaccctgctcgtgtggcacacctggcagaagcagacccagcggagcggggtcctgtgggacgtgcccagcccgcccgagacgcagaaggcggagctggaggagggcgtgtaccgcatcaagcagcaggggatcttcggcaagacccaggtcggggtgggcgtgcagaaggagggcgtcttccacaccatgtggcacgtgacccgcggggccgtgctcacgcacaacggcaagcgcctggagcccaactgggccagcgtcaagaaggacctgatctcctacgggggcgggtggcggctcagcgcccagtggcagaagggcgaggaggtccaggtgatcgcggtcgagcccggcaagaaccccaagaacttccagaccatgcccgggaccttccagaccacgaccggcgagatcggggccatcgccctggacttcaagcccggcacctccggcagccccatcatcaaccgcgaggggaaggtggtgggcctgtacgggaacggcgtcgtgaccaagaacgggggctacgtgagcggcatcgcccagacgaacgccgagccggacgggcccacccccgagctggaggaggagatgttcaagaagcggaacctcaccatcatggacctgcaccccggctccgggaagacccgcaagtacctgccggcgatcgtccgggaggccatcaagcgccggctccgcacgctgatcctggcccccacccgggtggtggccgccgagatggaggaggcgctcaagggcctgcccatccgctaccagaccaccgccaccaagtccgagcacaccgggcgggagatcgtcgacctgatgtgccacgccaccttcaccatgcgcctcctgtcccccgtgcgggtgccgaactacaacctgatcatcatggacgaggcccacttcacggaccccgccagcatcgcggcccgcggctacatctccacccgggtcggcatgggggaggccgccgcgatcttcatgaccgccacgccgcccggcacggccgacgccttcccgcagagcaacgcccccatccaggacgaggagcgcgacatccccgagcgctcctggaacagcgggaacgagtggatcaccgacttcgcgggcaagaccgtgtggttcgtgccctccatcaaggccgggaacgacatcgccaactgcctccggaagaacggcaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacgggcccgagcgcgtgatcctggcgggccccatgccggtcaccgccgccagcgccgcccagcggcgcgggcgggtgggccgcaacccccagaaggagaacgaccagtacatcttcaccgggcagcccctcaacaacgacgaggaccacgcgcactggaccgaggccaagatgctgctggacaacatcaacacccccgagggcatcatcccggccctcttcgagcccgagcgggagaagtccgccgcgatcgacggcgagtaccgcctgaagggggagagccggaagacgttcgtggagctgatgcgccggggcgacctccccgtctggctggcccacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacctacagcgacccgctggccctcaaggagttcaaggagttcgcggccgggcgcaagtccatcgccctggacctggtgacggagatcggccgggtgcccagccacctcgcccaccgcacccggaacgccctggacaacctggtcatgctccacacctccgagcacgggggccgcgcgtaccggcacgccgtggaggagctgcccgagaccatggagacgctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcggcatcctcacgctggccgccatcatcgcggccaacgagatgggcctgctcgagaccaccaagcgggacctggggatgagcaaggagccgggcgtggtgtcccccaccagctacctggacgtcgacctccaccccgcctccgcctggacgctgtacgcggtggccaccaccgtgatcacccccatgctgcgccacacgatcgagaacagcaccgccaacgtctccctcgccgccatcgcgaaccaggccgtggtgctgatggggctggacaagggctggccgatcagcaagatggacctcggggtccccctgctggccctcggctgctactcccaggtgaaccccctgaccctgaccgccgccgtgctcctgctgatcacgcactacgcgatcatcggccccgggctccaggccaaggccacccgggaggcccagaagcgcaccgccgcgggcatcatgaagaacccgaccgtcgacgggatcatgacgatcgacctggaccccgtgatctacgacagcaagttcgagaagcagctgggccaggtgatgctcctggtcctgtgcgccgtgcagctcctgctgatgcggacctcctgggccctctgcgaggccctgaccctggcgaccggccccatcacgaccctctgggaggggagccccggcaagttctggaacaccaccatcgccgtgtccatggccaacatcttccgcgggagctacctggccggcgccgggctggcgttctccatcatgaagtccgtcggcacgggcaagcgggggaccggctcccagggggagaccctcggcgagaagtggaagaagaagctgaaccagctgagccgcaaggacttcgacctctacaagaagtccgggatcaccgaggtggaccggaccgaggccaaggagggcctgaagcgcggcgagatcacgcaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacgcacgagatgtactggatcagcaacgggaccggcaacatcgtggcgtccgtcaacatggtgagccggctcctgctgaaccgcttcaccatgacccaccggcgcccgacgatcgagaaggacgtggacctcggcgccgggacccggcacgtcaacgccgagcccgagacccccaacatggacgtgatcggcgagcgcatcaagcggatcaaggaggagcacaactccacctggcactacgacgacgagaacccgtacaagacgtgggcctaccacgggagctacgaggtgaaggccaccggctccgcgagctccatgatcaacggggtcgtgaagctgctgaccaagccctgggacgtcgtgcccatggtgacccagatggccatgacggacaccacccccttcggccagcagcgcgtcttcaaggagaaggtggacacccggacgccgcgcagcatgcccggcacccggcgcgtgatggggatcaccgccgagtggctctggcggaccctgggccgcaacaagaagccccggctgtgcacgcgcgaggagttcaccaagaaggtccgcaccaacgccgcgatgggggccgtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggcgaagggcagccgcgccatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgcggacgacacggccggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcgggagcggccaggtggggacctacggcctgaacacgttcaccaacatggaggcccagctcatccggcagatggagggggagggcgtgctgtccaaggcggacctggagaacccccacctcccggagaagaagatcacccagtggctggagaccaagggcgtcgagcgcctgaagcggatggccatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcgcggatctcccagggcgccggctggagcctcaaggagacggcctgcctggggaaggcctacgcgcagatgtggtccctgatgtacttccaccgccgcgacctccggctggccagcaacgccatctgctccgccgtgcccgtgcactgggtcccgaccagccgcaccacctggtccatccacgcccaccaccagtggatgacgaccgaggacatgctgaccgtgtggaaccgggtgtggatcgaggacaacccctggatggaggacaagacccccgtcacgacctgggagaacgtgccctacctcggcaagcgcgaggaccagtggtgcgggagcctgatcggcctgaccagccgggcgacctgggcccagaacatcccgacggccatccagcaggtccgctccctcatcgggaacgaggagttcctggactacatgcccagcatgaagcggttccgcaaggaggaggagtccgagggcgccatctggtga

SEQ ID NO: 10013 - RNA, 9873 nt, synthetic construct
  misc_feature 1..9873: note = derived and/or modified CDS sequence (opt1) from DENV-3__HM756275__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcgcacggccaccctgatcctcgccggggtgagcctgctgccgatgtgccagtccagctccatgcggaagaccgactggctccccatggcggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtgcgggaggcgatcaagcgccggctccgcacgctgatcctggcccccacccgggtcgtggccgccgagatggaggaggccctcaaggggctgcccatccgctaccagaccaccgcgacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgccgcgcgcgggtacatcagcacccgggtgggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggagttcgccgcgggccgcaagagcatcgccctggacctggtcacggagatcgggcgggtgccctcccacctcgcccaccgcacccggaacgccctggacaacctggtgatgctccacaccagcgagcacggcgggcgcgcctaccggcacgcggtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcgcacgccccaggacaaccagctggcctacgtggtgatcgggatcctcacgctggccgccatcatcgccgcgaacgagatgggcctgctcgagaccaccaagcgggacctgggcatgtccaaggagccgggggtcgtgagccccacctcctacctggacgtggacctccaccccgccagcgcctggacgctgtacgccgtcgcgaccaccgtgatcacccccatgctgcgccacacgatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgccatcatcggccccggcctccaggcgaaggccacccgggaggcccagaagcgcaccgccgccgggatcatgaagaacccgaccgtggacggcatcatgacgatcgacctggaccccgtcatctacgactccaagttcgagaagcagctgggccaggtgatgctcctggtgctgtgcgtcgtgcagctcctgctgatgcggaccagctgggcgctctgcgaggccctgaccctggccaccggccccatcacgaccctctgggagggctcccccgggaagttctggaacaccaccatcgccgtgagcatggcgaacatcttccgcggctcctacctggccggggccggcctggccttcagcatcatgaagtccgtcgggacgggcaagcggggcaccgggagccagggcgagaccctcggggagaagtggaagaagaagctgaaccagctgagccgcaaggacttcgacctctacaagaagtccggcatcaccgaggtggaccggaccgaggccaaggaggggctgaagcgcggcgagatcacgcaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgcggagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgcggagtggctctggcggaccctggggcgcaacaagaagccccggctgtgcacgcgcgaggagttcaccaagaaggtccgcaccaacgccgccatgggcgccgtgttcaccgaggagaaccagtgggactccgcgaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacacggccgggtgggacacccgcatcaccgaggacgacctgcacaacgaggagaagatcacccagcagatggacccggagcaccggcagctcgcgaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgcgaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctcaaggagacggcgtgcctgggcaaggcctacgcccagatgtggagcctgatgtacttccaccgccgcgacctccggctggcctccaacgcgatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggccacctgggcccagaacatcccgacggcgatccagcaggtccgcagcctcatcggcaacgaggagttcctggactacatgccctccatgaagcggttccgcaaggaggaggagagcgagggggccatctggtga

SEQ ID NO: 10014 - RNA, 9873 nt, synthetic construct
  misc_feature 1..9873: note = derived and/or modified CDS sequence (opt1) from DENV-3__JF937632__SS-prME
  source 1..9873: mol_type = other RNA
accagcctctgcctcatgatgatcctccccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatcggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagcgcgccgcggacatcacgtgggaggaggaggccgagcagaccggcgtgagccacaacctgatgatcaccgtggacgacgacgggaccatgcggatcaaggacgacgagaccgagaacatcctcacggtcctgctgaagaccgccctcctgatcgtgtccggcatcttcccgtacagcatccccgccaccctgctcgtgtggcacacctggcagaagcagacgcagcgctccggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgcggtgctcacctacaacgggaagcggctggagcccaactgggcctccgtcaagaaggacctgatcagctacggcgggggctggcgcctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgggagggcaaggtggtggggctgtacggcaacggggtcgtgacgaagaacggcgggtacgtgtccggcatcgcccagaccaacgccgagccggacggccccacccccgagctggaggaggagatgttcaagaagcgcaacctcaccatcatggacctgcaccccgggagcggcaagacgcggaagtacctgccggccatcgtccgcgaggcgatcaagcggcgcctccggaccctgatcctggcccccacccgcgtggtggccgccgagatggaggaggccctcaaggggctgcccatccggtaccagaccacggcgaccaagtccgagcacaccggccgcgagatcgtcgacctgatgtgccacgccaccttcacgatgcggctcctgagccccgtgcgcgtgccgaactacaacctgatcatcatggacgaggcccacttcaccgaccccgcctccatcgccgcgcgggggtacatcagcacccgcgtcggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtgtggttcgtgcccagcatcaaggcgggcaacgacatcgccaactgcctccgcaagaacgggaagaaggtcatccagctgtcccggaagacgttcgacaccgagtaccagaagaccaagctgaacgactgggacttcgtggtgaccacggacatcagcgagatgggcgccaacttcaaggccgaccgcgtcatcgacccgcggcgctgcctcaagcccgtgatcctgaccgacggccccgagcgggtgatcctggccgggcccatgccggtcaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtactccgacccgctggccctcaaggagttcaaggagttcgccgcgggccgcaagagcatcgccctggacctggtgaccgagatcgggcgcgtgccctcccacctcgcccaccggacccgcaacgccctggacaacctggtcatgctccacaccagcgagcacggcgggcgggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccaccaagcgcgacctgggcatgtccaaggagccgggggtggtgagccccacgtcctacctggacgtcgacctccaccccgccagcgcctggaccctgtacgccgtggcgaccaccgtgatcacgcccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgcgaggcccagaagcggaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtcgggaccggcaagcgcggcaccgggccgcagggcgagaccctcggggagaagtggaagaagaagctgaaccagctgagccggaaggacttcgacctctacaagaagtccggcatcaccgaggtggaccgcacggaggcgaaggaggggctgaagcggggcgagatcacccaccacgccgtgtcccgcggcagcgccaagctgcagtggttcgtcgagcggaacatggtgatccccgaggggcgcgtgatcgacctcggctgcgggcggggcgggtggtcctactactgcgccggcctgaagaaggtcaccgaggtgcgcggctacaccaagggcgggcccgggcacgaggagcccgtgccgatgagcacgtacggctggaacatcgtcaagctgatgtccgggaaggacgtgttctacctgccgcccgagaagtgcgacaccctgctgtgcgacatcggcgagagctcccccagcccgaccgtggaggagtcccgcaccatccgggtcctgaagatggtggagccctggctcaagaacaaccagttctgcatcaaggtgctgaacccctacatgcccacggtcatcgagcacctggagcgcctccagcggaagcacggcgggatgctggtgcgcaacccgctgagccggaactccacccacgagatgtactggatcagcaacggcaccgggaacatcgtggcctccgtcaacatggtgagccgcctcctgctgaaccggttcaccatgacgcaccgccggcccaccatcgagaaggacgtggacctcggcgcgggcacccgccacgtcaacgccgagcccgagaccccgaacatggacgtgatcggggagcggatcaagcgcatcaaggaggagcacaactccacgtggcactacgacgacgagaacccctacaagacctgggcctaccacggcagctacgaggtgaaggccaccgggtccgccagctccatgatcaacggcgtcgtgaagctgctgaccaagccctgggacgtcgtgcccatggtgacgcagatggcgatgaccgacaccaccccgttcgggcagcagcgggtcttcaaggagaaggtggacacgcgcacgccccggagcatgcccggcacccgccgggtgatgggcatcaccgccgagtggctctggcgcacgctggggcggaacaagaagccccgcctgtgcacccgcgaggagttcaccaagaaggtccggaccaacgccgccatgggcgcggtgttcacggaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcaccgcctcggctacatcctgcgggacatcagcaagatccccggcggggccatgtacgccgacgacaccgcggggtgggacacccgcatcaccgaggacgacctgcacaacgaggagaagatcacgcagcagatggaccccgagcaccggcagctcgccaacgccatcttcaagctgacctaccagaacaaggtcgtgaaggtgcagcgccccacccccaccgggaccgtcatggacatcatctcccggaaggaccagcgcggcagcggccaggtgggcacgtacgggctgaacaccttcaccaacatggaggcccagctcatccggcagatggagggcgagggggtgctgtccaaggccgacctggagaacccgcacctccccgagaagaagatcacccagtggctggagacgaagggcgtcgagcgcctgaagcggatggcgatcagcggcgacgactgcgtggtgaagcccatcgacgaccgcttcgccaacgccctcctggccctgaacgacatggggaaggtccggaaggacatcccccagtggcagccgtccaagggctggcacgactggcagcaggtccccttctgcagccaccacttccacgagctcatcatgaaggacgggcgcaagctggtggtcccctgccggccccaggacgagctgatcggccgcgcccgcatctcccagggggcgggctggagcctcaaggagaccgcctgcctgggcaaggcctacgcccagatgtggtccctgatgtacttccaccggcgcgacctccggctggcgagcaacgccatctgctccgccgtgccggtgcactgggtccccaccagccgcaccacgtggtccatccacgcccaccaccagtggatgaccaccgaggacatgctgaccgtgtggaaccgggtgtggatcgaggacaacccctggatggaggacaagacgcccgtcaccacctgggagaacgtgccgtacctcgggaagcgcgaggaccagtggtgcggcagcctgatcgggctgaccagccgggccacgtgggcgcagaacatccccaccgccatccagcaggtccgctccctcatcggcaacgaggagttcctggactacatgcccagcatgaagcggttccgcaaggaggaggagtccgagggggccatctggtga

SEQ ID NO: 10015 - RNA, 9873 nt, synthetic construct
  misc_feature 1..9873: note = derived and/or modified CDS sequence (opt1) from DENV-3__HM756281__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcgtgaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgaaggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtggcctggcgcaccgccaccctgatcctcgccggggtcagcctgctgccggtgtgccagtccagctccatgcggaagaccgactggctccccatggcggtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacatcacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtcccctcccacctcgcccaccgcacccggaacgccctggacaacctggtgatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccaccaagcgggacctgggcatgtccaaggagccgggggtggtcagccccacgtcctacctggacgtggacctccaccccgccagcgcctggaccctgtacgccgtggcgaccaccgtcatcacgcccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttccgggagaaggtggacacgcgcaccccgcggagcatgcccggcacccgccgggtcatgggcatcaccgccgagtggctctggcgcacgctggggcggaacaagaagccccgcctgtgcacccgcgaggagttcaccaagaaggtgcggaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctcaaggagaccgcctgcctgggcaaggcctacgcccagatgtggagcctgatgtacttccaccgccgggacctccgcctggcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10016 - RNA, 9873 nt, synthetic construct
  misc_feature 1..9873: note = derived and/or modified CDS sequence (opt1) from DENV-3__JF937643__SS-prME
  source 1..9873: mol_type = other RNA
accagcctgtgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagaaggccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgccggggtgttcttcaccttcgtcctgctcctgtccggccagatcacctggcgggacatggcgcacacgctgatcatgatcggcagcaacgcctccgaccgcatggggatgggcgtgacctacctcgccctgatcgccaccttcaagatccagcccttcctggccctcgggttcttcctgcggaagctgaccagccgcgagaacctcctgctgggcgtgggcctcgcgatggccacgaccctgcagctgcccgaggacatcgagcagatggccaacgggatcgccctcggcctgatggcgctgaagctcatcgcccagttcgagacctaccagctgtggaccgccctgatcagcctcacgtgctccaacaccatcttcaccctgaccgtcgcctggcggacggccaccctgatcctcgcgggggtgagcctgctgccggtctgccagtccagctccatgcgcaagaccgactggctccccatggccgtggccgccatgggcgtgccgcccctcccgctgttcatcttcagcctcaaggacaccctgaagcggcgctcctggcccctgaacgagggggtcatggccgtgggcctcgtgagcatcctggcgtccagcctgctccgcaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcgccgtggacgacgacgggaccatgcggatcaaggacgacgagaccgagaacatcctcaccgtcctgctgaagaccgccctcctgatcgtgtccggcatcttcccgtacagcatccccgcgacgctgctcgtgtggcacacctggcagaagcagacccagcgctccggcgtcctgtgggacgtgcccagcccgcccgagacccagaaggccgagctggaggagggggtgtaccggatcaagcagcagggcatcttcgggaagacgcaggtcggcgtgggggtgcagaaggagggcgtcttccacaccatgtggcacgtgacccgcggcgccgtgctcacctacaacgggaagcggctggagcccaactgggcctccgtcaagaaggacctgatcagctacggcgggggctggcgcctctccgcgcagtggcagaagggggaggaggtccaggtgatcgccgtcgagcccggcaagaaccccaagaacttccagacgatgcccggcaccttccagaccaccacgggggagatcggcgccatcgccctggacttcaagcccgggaccagcggcagccccatcatcaaccgggagggcaaggtggtggggctgtacggcaacggggtcgtgaccaagaacggcgggtacgtgtccggcatcgcccagaccaacgcggagccggacggccccacgcccgagctggaggaggagatgttcaagaagcgcaacctcaccatcatggacctgcaccccgggagcggcaagacccggaagtacctgccggccatcgtccgcgaggccatcaagcggcgcctccggaccctgatcctggcccccacgcgcgtggtggccgcggagatggaggaggccctcaaggggctgcccatccggtaccagaccaccgccaccaagtccgagcacacgggccgcgagatcgtcgacctgatgtgccacgccaccttcaccatgcggctcctgagccccgtgcgcgtgccgaactacaacctgatcatcatggacgaggcccacttcaccgaccccgcgtccatcgccgcccgggggtacatcagcacgcgcgtcggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcacggacttcgccgggaagaccgtgtggttcgtgcccagcatcaaggccggcaacgacatcgccaactgcctccgcaagaacgggaagaaggtcatccagctgtcccggaagaccttcgacaccgagtaccagaagacgaagctgaacgactgggacttcgtggtgaccaccgacatcagcgagatgggcgccaacttcaaggcggaccgcgtcatcgacccgcggcgctgcctcaagcccgtgatcctgaccgacggccccgagcgggtgatcctggccgggcccatgccggtcacggccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacacggaccggaagtggtgcttcgacgggcagcgcaacaaccagatcctggaggagaacatggacgtcgagatctggaccaaggagggcgagaagaagaagctccggccccgctggctggacgcccggacctactccgacccgctggcgctcaaggagttcaaggagttcgccgccggccgcaagagcatcgccctggacctggtgaccgagatcgggcgcgtgccctcccacctcgcccaccggacgcgcaacgcgctggacaacctggtcatgctccacaccagcgagcacggcgggcgggcctaccgccacgccgtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcaccctggccgcggtgatcgccgccaacgagatgggcctgctcgagacgaccaagcgcgacctgggcatgtccaaggagccgggggtggtcagccccacctcctacctggacgtggacctccaccccgccagcgcgtggaccctgtacgccgtggccacgaccgtcatcacccccatgctgcggcacaccatcgagaactccacggccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacccactacgccatcatcggccccggcctccaggccaaggccacgcgcgaggcccagaagcggaccgcggccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcgcacgagctgggccctctgcgaggcgctgaccctggccaccggccccatcaccacgctctgggagggctcccccgggaagttctggaacaccaccatcgccgtcagcatggccaacatcttccggggctcctacctggccggggcgggcctggccttcagcatcatgaagtccgtggggaccggcaagcgcggcacggggagccagggcgagaccctcggggagaagtggaagaagaagctgaaccagctgagccggaaggacttcgacctctacaagaagtccggcatcaccgaggtggaccgcaccgaggccaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgcgggcctgaagaaggtgacggaggtgcgcggctacaccaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccacggtcgaggagagccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcacggggaacatcgtcgccagcgtgaacatggtgtcccgcctcctgctgaaccggttcaccatgacccaccgccggccgaccatcgagaaggacgtcgacctcggcgccggcacgcgccacgtgaacgccgagcccgagacccccaacatggacgtgatcggggagcggatcaagcgcatcaaggaggagcacaacagcacctggcactacgacgacgagaacccgtacaagacctgggcctaccacggctcctacgaggtcaaggcgacggggagcgcctccagcatgatcaacggcgtggtcaagctgctgaccaagccctgggacgtggtgcccatggtcacccagatggccatgaccgacacgacccccttcgggcagcagcgggtgttcaaggagaaggtggacacccgcaccccgcggagcatgcccggcacgcgccgggtcatgggcatcaccgccgagtggctctggcgcaccctggggcggaacaagaagccccgcctgtgcacccgggaggagttcacgaagaaggtgcgcaccaacgcggccatgggcgccgtgttcaccgaggagaaccagtgggactccgccaaggccgcggtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgcgatgtacgccgacgacaccgccgggtgggacacgcggatcaccgaggacgacctgcacaacgaggagaagatcacccagcagatggacccggagcaccgccagctcgccaacgccatcttcaagctgacctaccagaacaaggtggtgaaggtccagcggcccacgcccaccggcaccgtgatggacatcatcagccgcaaggaccagcggggctccggccaggtgggcacctacgggctgaacaccttcacgaacatggaggcgcagctcatccgccagatggagggcgagggggtcctgagcaaggccgacctggagaacccccacctcccggagaagaagatcacccagtggctggagaccaagggcgtggagcggctgaagcgcatggccatctccggcgacgactgcgtggtcaagcccatcgacgaccggttcgccaacgccctcctggcgctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggccggctggtccctcaaggagaccgcctgcctgggcaaggcgtacgcccagatgtggagcctgatgtacttccaccggcgcgacctccgcctggcctccaacgccatctgcagcgccgtgcccgtccactgggtgccgacgtcccggaccacctggagcatccacgcgcaccaccagtggatgaccacggacgacatgctgaccgtgtggaaccgcgtctggatcgaggacaacccctggatggaggacaagacccccgtgaccacgtgggagaacgtgccctacctcgggaagcgggaggaccagtggtgcggcagcctgatcgggctgacctcccgcgccacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10017 - RNA, 9873 nt, synthetic construct
  misc_feature 1..9873: note = derived and/or modified CDS sequence (opt1) from DENV-3__HM181972__SS-prME
  source 1..9873: mol_type = other RNA
accagcctctgcctcatgatgatcctgcccgcggcgctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggtgctcgggttcttcctgcgcaagctgaccagccgggagaacctcctgctgggcgtcggcctcgccatggcgacgaccctgcagctgcccgaggacatcgagcagatggccaacgggatcgccctcggcctgatggccctgaagctcatcacccagttcgagacctaccagctgtggacggcgctgatcagcctgacctgctccaacaccatcttcaccctgacggtggcctggcgcaccgccaccctgatcctcgccggggtcagcctgctgccggtgtgccagtccagctccatgcggaagaccgactggctccccatggccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacatcacgtgggaggaggaggcggagcagaccggggtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtggtcgccgccgagatggaggaggccctcaaggggctgcccatccgctaccagaccacggccaccaagtccgagcacaccggccgggagatcgtggacctgatgtgccacgcgaccttcacgatgcgcctcctgagccccgtgcgggtcccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtgtggttcgtccccagcatcaaggccggcaacgacatcgcgaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgccgcgtccgccgcccagcggcgcggccgggtggggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcccacaaggtcgcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgccggccgcaagagcatcgcgctggacctggtgaccgagatcgggcgggtcccctcccacctcgcccaccgcacccggaacgccctggacaacctggtgatgctccacaccagcgagcacggcgggcgcgcctaccggcacgccgtggaggagctgcccgagacgatggagaccctgctcctgctgggcctcatgatcctgctgaccgggggcgcgatgctgttcctgatcagcggcaaggggatcggcaagacctccatcgggctgatctgcgtcatcgccagctccggcatgctctggatggccgagatcccgctgcagtggatcgccagcgccatcgtgctggagttcttcatgatggtgctcctgatccccgagcccgagaagcagcgcacgccccaggacaaccagctggcgtacgtcgtgatcgggatcctcaccctggccgccatcatcgccgccaacgagatgggcctgctcgagaccaccaagcgggacctgggcatgtccaaggagccgggggtggtcagccccacgtcctacctggacgtggacctccaccccgcgagcgcctggaccctgtacgccgtggccaccaccgtcatcacgcccatgctgcgccacaccatcgagaactccaccgcgaacgtgagcctcgccgccatcgccaaccaggccgtggtcctgatgggcctggacaaggggtggccgatctccaagatggacctcggcgtgcccctgctggcgctcgggtgctacagccaggtgaaccccctgaccctgacggccgccgtcctcctgctgatcacccactacgccatcatcggccccggcctccaggccaaggcgacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgccgtgcagctcctgctgatgcggaccagctgggcgctctgcgaggccctgaccctggccacgggccccatcaccaccctctgggagggctcccccgggaagttctggaacaccacgatcgccgtcagcatggcgaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggacttcgacctctacaagaagtccggcatcaccgaggtggaccggacggaggccaaggaggggctgaagcgcggcgagatcacccaccacgcggtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgccggcacccggcacgtgaacgcggagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggccatgaccgacaccacccccttcgggcagcagcgcgtgttcaaggagaaggtggacacgcggaccccgcgcagcatgcccggcacccggcgcgtcatgggcatcaccgcggagtggctctggcggacgctggggcgcaacaagaagccccggctgtgcacccgcgaggagttcaccaagaaggtgcgcaccaacgccgccatgggcgccgtgttcacggaggagaaccagtgggactccgcgaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgccgggtgggacacccgcatcaccgaggacgacctgcacaacgaggagaagatcacgcagcagatggacccggagcaccggcagctcgcgaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctcatccggcagatggagggcgagggggtcctgagcaaggccgacctggagaacccccacctcccggagaagaagatcacccagtggctggagacgaagggcgtggagcgcctgaagcggatggccatctccggcgacgactgcgtggtcaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggccggctggtccctcaaggagaccgcgtgcctgggcaaggcctacgcccagatgtggagcctgatgtacttccaccgccgcgacctccggctggcctccaacgcgatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggggaacgtgccctacctcggcaagcgcgaggaccagtggtgcgggagcctgatcggcctgacctcccgggccacgtgggcccagaacatcccgaccgcgatccagcaggtccgcagcctcatcgggaacgaggagttcctggactacatgccctccatgaagcggttccgcaaggaggaggagagcgagggcgccatctggtga

SEQ ID NO: 10018 - RNA, 9873 nt, synthetic construct
  misc_feature 1..9873: note = derived and/or modified CDS sequence (opt1) from DENV-3__HM631857__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacacggcgcacaccctgatcatgatcggcagcaacgcctccgaccggatggggatgggcgtgacctacctcgccctgatcgccaccttcaagatccagcccttcctggccctcgggttcttcctgcgcaagctgacgagccgggagaacctcctgctgggcgtgggcctcgcgatggccaccaccctgcagctgcccgaggacatcgagcagatggccaacgggatcgccctcggcctgatggcgctgaagctcatcacccagttcgagacgtaccagctgtggaccgccctgatcagcctgacctgctccaacaccatcttcacgctgaccgtcgcctggcgcaccgccaccctgatcctcgccggggtgagcctgctgccggtctgccagtccagctccatgcggaagacggactggctccccatggcggtggccgccatgggcgtgccgcccctcccgctgttcatcttcgggctcaaggacaccctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgacggtcgagaaggccgcggacatcacctgggaggaggaggccgagcagaccggggtgtcccacaacctgatgatcaccgtggacgacgacggcaccatgcgcatcaaggacgacgagacggagaacatcctcaccgtcctgctgaagaccgccctcctgatcgtgagcggcatcttcccgtactccatccccgccaccctgctcgtgtggcacacgtggcagaagcagacccagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacacgatgtggcacgtgacccgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggacgttccagaccaccaccggcgagatcggggcgatcgccctggacttcaagcccggcacgtccggcagccccatcatcaaccgcgaggggaaggtggtgggcctgtacgggaacggcgtcgtgaccaagaacgggggctacgtgagcggcatcgcccagaccaacgccgagccggacgggcccacccccgagctggaggaggagatgttcaagaagcggaacctcacgatcatggacctgcaccccggctccgggaagacccgcaagtacctgccggccatcgtccgggaggcgatcaagcgccggctccgcaccctgatcctggcccccacccgggtggtggccgccgagatggaggaggccctcaagggcctgcccatccgctaccagacgaccgcgaccaagagcgagcacaccgggcgggagatcgccgacctgatgtgccacgccacgttcaccatgcgcctcctgtcccccgtccgggtgccgaactacaacctgatcatcatggacgaggcccacttcaccgaccccgccagcatcgcggcccgcggctacatctccacccgggtgggcatgggggaggccgccgcgatcttcatgacggccacgccgcccggcaccgccgacgccttcccgcagagcaacgcccccatccaggacgaggagcgcgacatccccgagcgctcctggaacagcgggaacgagtggatcaccgacttcgcgggcaagacggtctggttcgtgccctccatcaaggccgggaacgacatcgccaactgcctccggaagaacggcaagaaggtgatccagctgagccgcaagaccttcgacaccgagtaccagaagaccaagctgaacgactgggacttcgtcgtgacgaccgacatctccgagatgggcgccaacttcaaggccgaccgggtgatcgacccgcgccggtgcctcaagcccgtcatcctgaccgacgggcccgagcgcgtgatcctggcgggccccatgccggtgaccgccgccagcgccgcccagcggcgcgggcgggtcggccgcaacccccagaaggagaacgaccagtacatcttcaccgggcagcccctcaacaacgacgaggaccacgcgcactggacggaggccaagatgctgctggacaacatcaacacccccgagggcatcatcccggccctcttcgagcccgagcgggagaagtccgccgcgatcgacggcgagtaccgcctgaagggggagagccggaagaccttcgtggagctgatgcgccggggcgacctccccgtgtggctggcccacaaggtcgcctccgaggggatcaagtacaccgaccgcaagtggtgcttcgacggccagcggaacaaccagatcctggaggagaacatggacgtggagatctggacgaaggagggcgagaagaagaagctccgcccccggtggctggacgcccgcacctacagcgacccgctggccctcaaggagttcaaggagttcgcggccgggcgcaagtccatcgccctggacctggtcaccgagatcggccgggtgcccagccacctcgcccaccgcacccggaacgccctggacaacctggtgatgctccacacgtccgagcacgggggccgcgcgtaccggcacgccgtcgaggagctgcccgagaccatggagaccctgctcctgctggggctcatgatcctgctgaccggcggcgccatgctgttcctgatcagcgggaagggcatcgggaagacgagcatcggcctgatctgcgtgatcgcctccagcgggatgctctggatggccgagatcccgctgcagtggatcgcgtccgccatcgtgctggagttcttcatgatggtcctcctgatccccgagcccgagaagcagcgcacgccccaggacaaccagctggcctacgtggtgatcggcatcctcaccctggccgccgtcatcgcggccaacgagatgggcctgctcgagaccacgaagcgggacctggggatgagcaaggagccgggcgtggtgtcccccaccagctacctggacgtcgacctccaccccgcctccgcctggaccctgtacgcggtggccaccacggtgatcacccccatgctgcgccacaccatcgagaacagcaccgccaacgtctccctcgccgccatcgcgaaccaggccgtggtgctgatggggctggacaagggctggccgatcagcaagatggacctcggggtccccctgctggccctcggctgctactcccaggtgaaccccctgacgctgaccgccgccgtgctcctgctgatcacccactacgcgatcatcggccccgggctccaggccaaggccacccgggaggcccagaagcgcacggccgcgggcatcatgaagaacccgaccgtcgacgggatcatgaccatcgacctggaccccgtgatctacgacagcaagttcgagaagcagctgggccaggtgatgctcctggtcctgtgcgccgtgcagctcctgctgatgcggacctcctgggccctctgcgaggccctgacgctggcgaccggccccatcaccaccctctgggaggggagccccggcaagttctggaacacgaccatcgccgtgtccatggccaacatcttccgcgggagctacctggccggcgccgggctggcgttctccatcatgaagtccgtcggcaccggcaagcgggggaccggctcccagggggagaccctcggcgagaagtggaagaagaagctgaaccagctgagccgcaaggacttcgacctctacaagaagtccgggatcacggaggtggaccggaccgaggccaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacacgaagggcgggcccggccacgaggagcccgtgcccatgagcacctacgggtggaacatcgtcaagctgatgtccggcaaggacgtgttctacctcccgcccgagaagtgcgacaccctgctgtgcgacatcggcgagagctcccccagccccaccgtggaggagtcccgcacgatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacccacgagatgtactggatcagcaacgggaccggcaacatcgtggcgtccgtcaacatggtgagccggctcctgctgaaccgcttcacgatgacccaccggcgcccgaccatcgagaaggacgtggacctcggcgccgggacccggcacgtcaacgtggagcccgagacgcccaacatggacgtgatcggcgagcgcatcaagcggatcaaggaggagcacaactccacctggcactacgacgacgagaacccgtacaagacctgggcctaccacgggagctacgaggtcaaggccaccggctccgccagctccatgatcaacggggtggtcaagctgctgacgaagccctgggacgtggtgcccatggtcacccagatggcgatgaccgacaccacgcccttcggccagcagcgcgtgttcaaggagaaggtggacacccggaccccgcgcagcatgcccggcacccggcgcgtcatggggatcacggccgagtggctctggcggaccctgggccgcaacaagaagccccggctgtgcacccgcgaggagttcaccaagaaggtgcgcacgaacgccgccatgggggcggtgttcaccgaggagaaccagtgggacagcgccaaggccgccgtcgaggacgaggacttctggaagctcgtggaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtcgagggcgagggcctgcacaagctcgggtacatcctgcgggacatcagcaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccggcacggtgatggacatcatctcccggaaggaccagcgcgggagcggccaggtggggacctacggcctgaacaccttcaccaacatggaggcccagctcatccggcagatggagggggagggcgtcctgtccaaggccgacctggagaacccccacctcccggagaagaagatcacgcagtggctggagaccaagggcgtggagcgcctgaagcggatggcgatcagcggggacgactgcgtggtcaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtccactgggtgccgaccagccgcacgacctggtccatccacgcccaccaccagtggatgaccaccgaggacatgctgacggtgtggaaccgggtctggatcgaggacaacccctggatggaggacaagacccccgtgaccacctgggagaacgtgccctacctcggcaagcgcgaggaccagtggtgcgggagcctgatcggcctgacgagccgggccacctgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10019 - RNA, 9873 nt, synthetic construct
  misc_feature 1..9873: note = derived and/or modified CDS sequence (opt1) from DENV-3__HM631860__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcgtgaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgaaggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacacctacttcaccctgacggtggcctggcgcaccgccaccctgatcctcgccggggtcagcctgctgccggtgtgccagtccagctccatgcggaagaccgactggctccccatggcggtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacatcacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtcccctcccacctcgcccaccgcacccggaacgccctggacaacctggtgatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccaccaagcgggacctgggcatgtccaaggagccgggggtggtcagccccacgtcctacctggacgtggacctccaccccgccagcgcctggaccctgtacgccgtggcgaccaccgtcatcacgcccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccggctgtgcacccgcgaggagttcaccaagaaggtgcgcaccaacgccgccatgggcgcggtgttcacggaggagaaccagtgggactccgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctcatccggcagatggagggcgagggggtcctgagcaaggccgacctggagaacccccacctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10020 - RNA, 9873 nt, synthetic construct
  misc_feature 1..9873: note = derived and/or modified CDS sequence (opt1) from DENV-3__HM181977__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcgtgaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgaaggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtggcctggcgcaccgccaccctgatcctcgccggggtcagcctgctgccggtgtgccagtccagctccatgcggaagaccgactggctccccatggcggtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacatcacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtcccctcccacctcgcccaccgcacccggaacgccctggacaacctggtgatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccaccaagcgggacctgggcatgtccaaggagccgggggtggtcagccccacgtcctacctggacgtggacctccaccccgccagcgcctggaccctgtacgccgtggcgaccaccgtcatcacgcccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccggctgtgcacccgcgaggagttcaccaagaaggtgcgcaccaacgccgccatgggcgcggtgttcacggaggagaaccagtgggactccgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctcatccggcagatggagggcgagggggtcctgagcaaggccgacctggagaacccccacctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10021 - RNA, 9873 nt, synthetic construct
  misc_feature 1..9873: note = derived and/or modified CDS sequence (opt1) from DENV-3__HM181978__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagctccgccagcgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatctccctgacctgcagcaacaccatcttcaccctgacggtcgcctggcgcaccgccaccctgatcctcgccggggtgtccctgctgccggtctgccagagctccagcatgcggaagaccgactggctccccatggcggtggccgccatgggcgtgccgcccctcccgctgttcatcttcgggctcaaggacacgctgaagcgccgctcctggcccctgaacgagggcgtcatggccgtgggcctcgtgagcatcctggcctccagcctgctccggaacgacgtccccatggcggggcccctggtggccggcgggctgctcatcgcctgctacgtgatcaccggcacctccgccgacctgaccgtcgagaaggccgcggacatcacgtgggaggaggaggccgagcagaccggggtgagccacaacctgatgatcaccgtggacgacgacggcaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggcctccgtcaagaaggacctgatcagctacgggggcgggtggcggctctccgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcaccagcggcagccccatcatcaaccgcgaggggaaggtggtgggcctgtacgggaacggcgtcgtgacgaagaacgggggctacgtgtccggcatcgcccagaccaacgccgagccggacgggcccacccccgagctggaggaggagatgttcaagaagcggaacctcaccatcatggacctgcaccccggcagcgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagtccgagcacaccgggcgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcggctacatcagcacccgggtcggcatgggggaggccgccgccatcttcatgaccgcgacgccgcccggcaccgccgacgccttcccgcagtccaacgcccccatccaggacgaggagcgcgacatccccgagcgcagctggaactccgggaacgagtggatcaccgacttcgccggcaagaccgtgtggttcgtgcccagcatcaaggcggggaacgacatcgccaactgcctccggaagaacggcaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacgggcccgagcgcgtgatcctggccggccccatgccggtcaccgcggcctccgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagtcccggaagaccttcgtggagctgatgcgccggggcgacctccccgtctggctggcgcacaaggtggccagcgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtactccgacccgctggccctcaaggagttcaaggagttcgccgcggggcgcaagagcatcgccctggacctggtgaccgagatcggccgggtgccctcccacctcgcccaccgcacccggaacgccctggacaacctggtcatgctccacaccagcgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagacctccatcggcctgatctgcgtgatcgccagctccgggatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgtccaaggagccgggcgtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatggggctggacaagggctggccgatctccaagatggacctcggggtccccctgctggccctcggctgctacagccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggaggggtcccccggcaagttctggaacaccacgatcgcggtgagcatggccaacatcttccgcgggtcctacctggccggcgccgggctggccttcagcatcatgaagtccgtcggcaccggcaagcgggggaccggcagccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgagccgggggtccgccaagctgcagtggttcgtcgagcgcaacatggtgatcccggagggccgggtgatcgacctcgggtgcggccgcgggggctggagctactactgcgccggcctgaagaaggtcaccgaggtgcgggggtacaccaagggcgggcccggccacgaggagcccgtgcccatgtccacgtacgggtggaacatcgtcaagctgatgagcggcaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgtcccgcaacagcacccacgagatgtactggatctccaacgggaccggcaacatcgtggccagcgtcaacatggtgtcccggctcctgctgaaccgcttcaccatgacgcaccggcgcccgaccatcgagaaggacgtggacctcggcgcggggacccggcacgtcaacgccgagcccgagacccccaacatggacgtgatcggcgagcgcatcaagcggatcaaggaggagcacaacagcacgtggcactacgacgacgagaacccgtacaagacctgggcctaccacgggtcctacgaggtgaaggccaccggcagcgcctccagcatgatcaacggggtcgtgaagctgctgaccaagccctgggacgtcgtgcccatggtgacgcagatggcgatgaccgacaccacccccttcggccagcagcgcgtcttcaaggagaaggtggacacgcggaccccgcgcagcatgcccggcacccggcgcgtgatggggatcaccgccgagtggctctggcggacgctgggccgcaacaagaagccccggctgtgcacccgcgaggagttcaccaagaaggtccgcaccaacgccgccatgggggcggtgttcacggaggagaaccagtgggactccgccaaggccgccgtggaggacgaggacttctggaagctcgtcgaccgggagcgcgagctgcacaagctgggcaagtgcgggagctgcgtgtacaacatgatgggcaagcgggagaagaagctcggcgagttcgggaaggccaagggctcccgcgcgatctggtacatgtggctgggggcccggtacctggagttcgaggccctcggcttcctgaacgaggaccactggttcagccgcgagaactcctacagcggggtggagggcgagggcctgcacaagctcgggtacatcctgcgggacatctccaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcgggtccggccaggtggggacgtacggcctgaacaccttcaccaacatggaggcccagctcatccggcagatggagggggagggcgtgctgagcaaggccgacctggagaacccccacctcccggagaagaagatcacccagtggctggagacgaagggcgtcgagcgcctgaagcggatggcgatctccggggacgactgcgtggtgaagcccatcgacgaccgcttcgccaacgccctcctggccctgaacgacatgggcaaggtccggaaggacatcccccagtggcagcccagcaaggggtggcacgactggcagcaggtcccgttctgctcccaccacttccacgagctcatcatgaaggacggccgcaagctggtggtcccctgccggccccaggacgagctgatcgggcgcgcccggatcagccagggcgcgggctggtccctcaaggagaccgcctgcctggggaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgacctcccgggccacgtgggcgcagaacatcccgaccgccatccagcaggtccgcagcctcatcgggaacgaggagttcctggactacatgccctccatgaagcggttccgcaaggaggaggagagcgagggcgccatctggtga

SEQ ID NO: 10022 - RNA, 9873 nt, synthetic construct
  misc_feature 1..9873: note = derived and/or modified CDS sequence (opt1) from DENV-3__JN183884__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaagatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcgcacaacggccgcctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggccgacatggggtgcgtcatcaactggaagggcaaggagctgaagtgcggcagcgggatcttcgtgacgaacgaggtgcacacctggaccgagcagtacaagttccaggcggactcccccaagcgcctcgccaccgccatcgccggcgcctgggagaacggggtctgcggcatccgcagcacgacccggatggagaacctgctgtggaagcagatcgcgaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggcggggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtgggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtcgcctggcgcacggccaccctgatcctcgccggggtgagcctgctgccggtctgccagtccagctccatgcggaagaccgactggctccccatggcggtggccgccatgggcgtgccgcccctcccgctgttcatcttcgggctcaaggacaccctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcacgggcaccagcgccgacctgaccgtcgagaaggccgcggacatcacctgggaggaggaggccgagcagacgggggtgtcccacaacctgatgatcaccgtggacgacgacggcaccatgcgcatcaaggacgacgagaccgagaacatcctcaccgtcctgctgaagacggccctcctgatcgtgagcggcatcttcccgtactccatccccgccaccctgctcgtgtggcacacctggcagaagcagacccagcggagcggggtcctgtgggacgtgcccagcccgcccgagacgcagaaggccgagctggaggagggcgtgtaccgcatcaagcagcaggggatcttcggcaagacccaggtcggggtgggcgtgcagaaggagggcgtcttccacaccatgtggcacgtgacccgcggggcggtgctcacgtacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagaccacgaccggcgagatcggggcgatcgccctggacttcaagcccggcacctccggcagccccatcatcaaccgcgaggggaaggtggtgggcctgtacgggaacggcgtcgtgaccaagaacgggggctacgtgagcggcatcgcccagacgaacgccgagccggacgggcccacccccgagctggaggaggagatgttcaagaagcggaacctcaccatcatggacctgcaccccggctccgggaagacccgcaagtacctgccggccatcgtccgggaggcgatcaagcgccggctccgcacgctgatcctggcccccacccgggtggtggccgccgagatggaggaggccctcaagggcctgcccatccgctaccagaccaccgcgaccaagtccgagcacaccgggcgggagatcgtcgacctgatgtgccacgccaccttcaccatgcgcctcctgtcccccgtgcgggtgccgaactacaacctgatcatcatggacgaggcccacttcacggaccccgccagcatcgccgcgcgcggctacatctccacccgggtcggcatgggggaggccgccgccatcttcatgaccgcgacgccgcccggcacggccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacccccgagggcatcatcccggccctcttcgagcccgagcgggagaagtccgccgccatcgacggcgagtaccgcctgaagggggagagccggaagacgttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacctacagcgacccgctggccctcaaggagttcaaggagttcgccgcggggcgcaagtccatcgccctggacctggtgacggagatcggccgggtgcccagccacctcgcccaccgcacccggaacgccctggacaacctggtcatgctccacacctccgagcacgggggccgcgcctaccggcacgcggtggaggagctgcccgagaccatggagacgctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcacgctggccgccatcatcgccgcgaacgagatgggcctgctcgagaccaccaagcgggacctggggatgagcaaggagccgggcgtggtgtcccccaccagctacctggacgtcgacctccaccccgcctccgcctggacgctgtacgccgtggcgaccaccgtgatcacccccatgctgcgccacacgatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgaccgccgccgtgctcctgctgatcacgcactacgccatcatcggccccgggctccaggcgaaggccacccgggaggcccagaagcgcaccgccgccggcatcatgaagaacccgaccgtcgacgggatcatgacgatcgacctggaccccgtgatctacgacagcaagttcgagaagcagctgggccaggtgatgctcctggtcctgtgcgcggtgcagctcctgctgatgcggacctcctgggccctctgcgaggccctgaccctggccaccggccccatcacgaccctctgggaggggagccccggcaagttctggaacaccaccatcgcggtgtccatggccaacatcttccgcgggagctacctggccggcgccgggctggccttctccatcatgaagtccgtcggcacgggcaagcgggggaccggctcccagggggagaccctcggcgagaagtggaagaagaagctgaaccagctgagccgcaaggacttcgacctctacaagaagtccgggatcaccgaggtggaccggaccgaggcgaaggagggcctgaagcgcggcgagatcacgcaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacgcacgagatgtactggatcagcaacgggaccggcaacatcgtggcctccgtcaacatggtgagccggctcctgctgaaccgcttcaccatgacccaccggcgcccgacgatcgagaaggacgtggacctcggcgcggggacccggcacgtcaacgccgagcccgagacccccaacatggacgtgatcggcgagcgcatcaagcggatcaaggaggagcacaactccacctggcactacgacgacgagaacccgtacaagacgtgggcctaccacgggagctacgaggtgaaggccaccggctccgccagctccatgatcaacggggtcgtgaagctgctgaccaagccctgggacgtcgtgcccatggtgacccagatggcgatgacggacaccacccccttcggccagcagcgcgtcttcaaggagaaggtggacacccggacgccgcgcagcatgcccggcacccggcgcgtgatggggatcaccgccgagtggctctggcggaccctgggccgcaacaagaagccccggctgtgcacgcgcgaggagttcaccaagaaggtccgcaccaacgccgccatgggggcggtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacacggcgggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcgggagcggccaggtggggacctacggcctgaacacgttcaccaacatggaggcccagctcatccggcagatggagggggagggcgtgctgtccaaggccgacctggagaacccccacctcccggagaagaagatcacccagtggctggagaccaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagacggcctgcctggggaaggcctacgcccagatgtggtccctgatgtacttccaccgccgcgacctccggctggcgagcaacgccatctgctccgccgtgcccgtgcactgggtcccgaccagccgcaccacctggtccatccacgcccaccaccagtggatgacgaccgaggacatgctgaccgtgtggaaccgggtgtggatcgaggacaacccctggatggaggacaagacccccgtcacgacctgggagaacgtgccctacctcggcaagcgcgaggaccagtggtgcgggagcctgatcggcctgaccagccgggccacctgggcgcagaacatcccgacggccatccagcaggtccgctccctcatcgggaacgaggagttcctggactacatgcccagcatgaagcggttccgcaaggaggaggagtccgagggcgccatctggtga

SEQ ID NO: 10023 - RNA, 9873 nt, synthetic construct
  misc_feature 1..9873: note = derived and/or modified CDS sequence (opt1) from DENV-3__HQ541785__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcgccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggagttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcaccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgacgacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10024 - RNA, 9873 nt, synthetic construct
  misc_feature 1..9873: note = derived and/or modified CDS sequence (opt1) from DENV-3__HM181975__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcgtcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagcacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtggcctggcgcacggccaccctgatcctcgccggggtcagcctgctgccgatgtgccagtccagctccatgcggaagaccgactggctccccatggcggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcacggggacctccgccgacctgaccgtcgagaaggccgcggacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgcggtgctcacgtacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagaccacgaccggggagatcggcgcgatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtccgggaggcgatcaagcgccggctccgcacgctgatcctggcccccacccgggtggtggccgccgagatggaggaggccctcaaggggctgcccatccgctaccagaccaccgcgacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgccgcgcgcgggtacatcagcacccgggtcggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggagttcgccgcgggccgcaagagcatcgccctggacctggtgacggagatcgggcgggtgccctcccacctcgcccaccgcacccggaacgccctggacaacctggtcatgctccacaccagcgagcacggcgggcgcgcctaccggcacgcggtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcacgctggccgccatcatcgccgcgaacgagatgggcctgctcgagaccaccaagcgggacctgggcatgtccaaggagccgggggtggtgagccccacctcctacctggacgtcgacctccaccccgccagcgcctggacgctgtacgccgtggcgaccaccgtgatcacccccatgctgcgccacacgatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgaccgccgccgtgctcctgctgatcacgcactacgccatcatcggccccggcctccaggcgaaggccacccgggaggcccagaagcgcaccgccgccgggatcatgaagaacccgaccgtcgacggcatcatgacgatcgacctggaccccgtgatctacgactccaagttcgagaagcagctgggccaggtgatgctcctggtcctgtgcgtggtgcagctcctgctgatgcggaccagctgggcgctctgcgaggccctgaccctggccaccggccccatcacgaccctctgggagggctcccccgggaagttctggaacaccaccatcgccgtcagcatggcgaacatcttccgcggctcctacctggccggggccggcctggccttcagcatcatgaagtccgtggggacgggcaagcggggcaccgggagccagggcgagaccctcggggagaagtggaagaagaagctgaaccagctgagccgcaaggacttcgacctctacaagaagtccggcatcaccgaggtggaccggaccgaggccaaggaggggctgaagcgcggcgagatcacgcaccacgcggtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgtcccgcaacagcacgcacgagatgtactggatctccaacggcaccgggaacatcgtcgccagcgtgaacatggtgtcccggctcctgctgaaccgcttcaccatgatccaccggcgcccgaccatcgagaaggacgtcgacctcggcgccggcacgcggcacgtgaacgcggagcccgagacccccaacatggacgtgatcggggagcgcatcaagcggatcaaggaggagcacaacagcacctggcactacgacgacgagaacccgtacaagacctgggcctaccacggctcctacgaggtcaaggccacggggagcgcctccagcatgatcaacggcgtggtcaagctgctgaccaagccctgggacgtggtgcccatggtcacccagatggccatgaccgacacgacccccttcgggcagcagcgcgtgttcaaggagaaggtggacacccggaccccgcgcagcatgcccggcacgcggcgcgtcatgggcatcaccgcggagtggctctggcggaccctggggcgcaacaagaagccccggctgtgcacccgcgaggagttcacgaagaaggtgcgcaccaacgccgccatgggcgccgtgttcaccgaggagaaccagtgggactccgcgaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgccgggtgggacacgcgcatcaccgaggacgacctgcacaacgaggagaagatcacccagcagatggacccggagcaccggcagctcgcgaacgccatcttcaagctgacctaccagaacaaggtggtgaaggtccagcgccccacgcccaccggcaccgtgatggacatcatcagccggaaggaccagcgcggctccggccaggtgggcacctacgggctgaacaccttcacgaacatggaggcccagctcatccggcagatggagggcgagggggtcctgagcaaggccgacctggagaacccccacctcccggagaagaagatcacccagtggctggagaccaagggcgtggagcgcctgaagcggatggccatctccggcgacgactgcgtggtcaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggccggctggtccctcaaggagaccgcgtgcctgggcaaggcctacgcccagatgtggagcctgatgtacttccaccgccgcgacctccggctggcctccaacgcgatctgcagcgccgtgcccgtccactgggtgccgacgtcccgcaccacctggagcatccacgcccaccaccagtggatgaccacggaggacatgctgaccgtgtggaaccgggtctggatcgaggacaacccctggatggaggacaagacccccgtgaccacgtgggagaacgtgccctacctcgggaagcgcgaggaccagtggtgcggcagcctgatcgggctgacctcccgggccacctgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10025 - RNA, 9873 nt, synthetic construct
  misc_feature 1..9873: note = derived and/or modified CDS sequence (opt1) from DENV-3__HM631864__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagaaggccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaactccaccatgggcgtcctgtgcctcgccatcctgttcgaggaggtgatgcgcgggaagttcggcaagaagcacatgatcgccggggtgttcttcaccttcgtcctgctcctgagcggccagatcacctggcgggacatggcgcacacgctgatcatgatcggctccaacgccagcgaccgcatggggatgggcgtgacctacctcgccctgatcgccaccttcaagatccagcccttcctggccctcgggttcttcctgcggaagctgaccagccgcgagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatctccctgacctgcagcaacaccatcttcaccctgacggtcgcctggcggaccgccaccctgatcctcgccggggtgtccctgctgccggtctgccagagctccagcatgcgcaagaccgactggctccccatggcggtggccgccatgggcgtgccgcccctcccgctgttcatcttctccctcaaggacacgctgaagcggcgcagctggcccctgaacgagggggtcatggccgtgggcctcgtgtccatcctggccagctccctgctccgcaacgacgtccccatggcgggccccctggtggccgggggcctgctcatcgcctgctacgtgatcaccgggaccagcgccgacctgaccgtcgagaaggccgcggacatcacgtgggaggaggaggccgagcagaccggcgtgtcccacaacctgatgatcgccgtggacgacgacgggaccatgcggatcaaggacgacgagaccgagaacatcctcaccgtcctgctgaagacggccctcctgatcgtgagcggcatcttcccgtactccatccccgccaccctgctcgtgtggcacacctggcagaagcagacccagcgcagcggcgtcctgtgggacgtgcccagcccgcccgagacgcagaaggcggagctggaggagggggtgtaccggatcaagcagcagggcatcttcgggaagacccaggtcggcgtgggggtgcagaaggagggcgtcttccacaccatgtggcacgtgacccgcggcgccgtgctcacgtacaacgggaagcggctggagcccaactgggccagcgtcaagaaggacctgatctcctacggcgggggctggcgcctcagcgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggctcccccatcatcaaccgggagggcaaggtggtggggctgtacggcaacggggtcgtgaccaagaacggcgggtacgtgagcggcatcgcccagacgaacgccgagccggacggccccacccccgagctggaggaggagatgttcaagaagcgcaacctcaccatcatggacctgcaccccgggtccggcaagacccggaagtacctgccggcgatcgtccgcgaggccatcaagcggcgcctccggacgctgatcctggcccccacccgcgtggtggccgccgagatggaggaggcgctcaaggggctgcccatccggtaccagaccaccgccaccaagtccgagcacaccggccgcgagatcgtcgacctgatgtgccacgccaccttcaccatgcggctcctgtcccccgtgcgcgtgccgaactacaacctgatcatcatggacgaggcccacttcacggaccccgccagcatcgcggcccgggggtacatctccacccgcgtcggcatgggcgaggccgccgcgatcttcatgaccgccacgccgcccgggacggccgacgccttcccgcagagcaacgcccccatccaggacgaggagcgggacatccccgagcgctcctggaacagcggcaacgagtggatcaccgacttcgcggggaagaccgtgtggttcgtgccctccatcaaggccggcaacgacatcgccaactgcctccgcaagaacgggaagaaggtcatccagctgagccggaagaccttcgacacggagtaccagaagaccaagctgaacgactgggacttcgtggtgaccaccgacatctccgagatgggcgccaacttcaaggccgaccgcgtcatcgacccgcggcgctgcctcaagcccgtgatcctgacggacggccccgagcgggtgatcctggcggggcccatgccggtcaccgccgccagcgccgcccagcgccggggccgcgtggggcggaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccggacctacagcgacccgctggccctcaaggagttcaaggagttcgcggccggccgcaagtccatcgccctggacctggtgacggagatcgggcgcgtgcccagccacctcgcccaccggacccgcaacgccctggacaacctggtcatgctccacaccagcgagcacggcgggcgggcgtaccgccacgccgtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcggacgccccaggacaaccagctggcctacgtggtcatcgggatcctcacgctggccgccgtgatcgcggccaacgagatgggcctgctcgagaccaccaagcgcgacctgggcatgagcaaggagccgggggtggtctcccccaccagctacctggacgtggacctccaccccgcctccgcctggacgctgtacgcggtggccaccaccgtcatcacccccatgctgcggcacacgatcgagaacagcaccgccaacgtgtccctcgccgccatcgcgaaccaggccgtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgcgatcatcggccccggcctccaggccaaggccacccgcgaggcccagaagcggaccgccgcggggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcgcacctcctgggccctctgcgaggccctgaccctggcgaccggccccatcacgaccctctgggagggcagccccgggaagttctggaacaccaccatcgccgtctccatggccaacatcttccggggcagctacctggccggggccggcctggcgttctccatcatgaagtccgtggggacgggcaagcgcggcaccgggagccagggcgagaccctcggggagaagtggaagaagaagctgaaccagctgtcccggaaggacttcgacctctacaagaagtccggcatcaccgaggtggaccgcaccgaggccaaggaggggctgaagcggggcgagatcacgcaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacgcacgagatgtactggatcagcaacggcaccgggaacatcgtcgcgtccgtgaacatggtgagccgcctcctgctgaaccggttcaccatgacccaccgccggccgacgatcgagaaggacgtcgacctcggcgccggcacccgccacgtgaacgccgagcccgagacccccaacatggacgtgatcggggagcggatcaagcgcatcaaggaggagcacaactccacctggcactacgacgacgagaacccgtacaagacgtgggcctaccacggcagctacgaggtcaaggccaccgggtccgcgagcagcatgatcaacggcgtggtcaagctgctgaccaagccctgggacgtggtgcccatggtcacccagatggccatgacggacaccacccccttcgggcagcagcgggtgttcaaggagaaggtggacacccgcacgccgcggtccatgcccggcacccgccgggtcatgggcatcaccgccgagtggctctggcgcaccctggggcggaacaagaagccccgcctgtgcacgcgggaggagttcaccaagaaggtgcgcaccaacgccgcgatgggcgccgtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgcggacgacacggccgggtgggacacccggatcaccgaggacgacctgcacaacgaggagaagatcacccagcagatggacccggagcaccgccagctcgccaacgccatcttcaagctgacgtaccagaacaaggtggtgaaggtccagcggcccacccccaccggcaccgtgatggacatcatctcccgcaaggaccagcggggcagcggccaggtgggcacctacgggctgaacacgttcaccaacatggaggcccagctcatccgccagatggagggcgagggggtcctgtccaaggcggacctggagaacccccacctcccggagaagaagatcacccagtggctggagaccaagggcgtggagcggctgaagcgcatggccatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcgcgcatctcccagggggccggctggagcctcaaggagacggcctgcctgggcaaggcctacgcgcagatgtggtccctgatgtacttccaccggcgcgacctccgcctggccagcaacgccatctgctccgccgtgcccgtccactgggtgccgaccagccggaccacctggagcatccacgcccaccaccagtggatgacgaccgacgacatgctgaccgtgtggaaccgcgtctggatcgaggacaacccctggatggaggacaagacccccgtgacgacctgggagaacgtgccctacctcgggaagcgggaggaccagtggtgcggctccctgatcgggctgaccagccgcgcgacctgggcccagaacatcccgacggccatccagcaggtccggtccctcatcggcaacgaggagttcctggactacatgcccagcatgaagcgcttccggaaggaggaggagtccgagggggccatctggtga

SEQ ID NO: 10026 - RNA, 9873 nt, synthetic construct
  misc_feature 1..9873: note = derived and/or modified CDS sequence (opt1) from DENV-3__HM631859__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcgcacggccaccctgatcctcgccggggtgagcctgctgccgatgtgccagtccagctccatgcggaagaccgactggctccccatggcggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtgcgggaggcgatcaagcgccggctccgcacgctgatcctggcccccacccgggtcgtggccgccgagatggaggaggccctcaaggggctgcccatccgctaccagaccaccgcgacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgccgcgcgcgggtacatcagcacccgggtgggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggagttcgccgcgggccgcaagagcatcgccctggacctggtcacggagatcgggcgggtgccctcccacctcgcccaccgcacccggaacgccctggacaacctggtgatgctccacaccagcgagcacggcgggcgcgcctaccggcacgcggtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcgcacgccccaggacaaccagctggcctacgtggtgatcgggatcctcacgctggccgccatcatcgccgcgaacgagatgggcctgctcgagaccaccaagcgggacctgggcatgtccaaggagccgggggtcgtgagccccacctcctacctggacgtggacctccaccccgccagcgcctggacgctgtacgccgtcgcgaccaccgtgatcacccccatgctgcgccacacgatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgccatcatcggccccggcctccaggcgaaggccacccgggaggcccagaagcgcaccgccgccgggatcatgaagaacccgaccgtggacggcatcatgacgatcgacctggaccccgtcatctacgactccaagttcgagaagcagctgggccaggtgatgctcctggtgctgtgcgtcgtgcagctcctgctgatgcggaccagctgggcgctctgcgaggccctgaccctggccaccggccccatcacgaccctctgggagggctcccccgggaagttctggaacaccaccatcgccgtgagcatggcgaacatcttccgcggctcctacctggccggggccggcctggccttcagcatcatgaagtccgtcgggacgggcaagcggggcaccgggagccagggcgagaccctcggggagaagtggaagaagaagctgaaccagctgagccgcaaggacttcgacctctacaagaagtccggcatcaccgaggtggaccggaccgaggccaaggaggggctgaagcgcggcgagatcacgcaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgcggagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgcggagtggctctggcggaccctggggcgcaacaagaagccccggctgtgcacgcgcgaggagttcaccaagaaggtccgcaccaacgccgccatgggcgccgtgttcaccgaggagaaccagtgggactccgcgaaggccgccgtggaggacgaggacttctggcggctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacacggccgggtgggacacccggatcaccgaggacgacctgcacaacgaggagaagatcacccagcagatggacccggagcaccgccagctcgcgaacgccatcttcaagctgacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcccagctcatccgccagatggagggcgagggggtgctgagcaaggccgacctggagaacccccacctcccggagaagaagatcacccagtggctggagaccaagggcgtcgagcggctgaagcgcatggccatctccggcgacgactgcgtggtgaagcccatcgacgaccggttcgcgaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctcaaggagacggcgtgcctgggcaaggcctacgcccagatgtggagcctgatgtacttccaccgccgggacctccgcctggcctccaacgcgatctgcagcgccgtgcccgtgcactgggtcccgacctcccggaccacctggagcatccacgcccaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggcagcctgatcgggctgacctcccgcgccacctgggcccagaacatcccgacggcgatccagcaggtccggagcctcatcggcaacgaggagttcctggactacatgccctccatgaagcgcttccggaaggaggaggagagcgagggggccatctggtga

SEQ ID NO: 10027 - RNA, 9870 nt, synthetic construct
  misc_feature 1..9870: note = derived and/or modified CDS sequence (opt1) from DENV-3__HM631856__SS-prME
  source 1..9870: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcgtgaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgaaggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtggcctggcgcaccgccaccctgatcctcgccggggtcagcctgctgccggtgtgccagtccagctccatgcggaagaccgactggctccccatggcggtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacatcacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttccggaagcgcaacctcaccatcatggacctgcaccccgggagcggcaagacgcggaagtacctgccggccatcgtgcgcgaggcgatcaagcggcgcctccggaccctgatcctggcccccacccgcgtggtcgccgccgagatggaggaggccctcaaggggctgcccatccggtaccagaccacggcgaccaagtccgagcacaccggccgcgagatcgtggacctgatgtgccacgccaccttcacgatgcggctcctgagccccgtgcgcgtcccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtgtggttcgtccccagcatcaaggcgggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggagttcgccgcgggccgcaagagcatcgccctggacctggtgaccgagatcgggcgcgtcccctcccacctcgcccaccggacccgcaacgccctggacaacctggtgatgctccacaccagcgagcacggcgggcgggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggacttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgggtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagccccgcctgtgcacccgcgaggagttcaccaagaaggtgcggaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctcaaggagaccgcctgcctgggcaaggcctacgcccagatgtggagcctgatgtacttccaccgccgggacctccgcctggcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10028 - RNA, 9873 nt, synthetic construct
  misc_feature 1..9873: note = derived and/or modified CDS sequence (opt1) from DENV-3__HM756276__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcgtgaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtggcctggcgcaccgccaccctgatcctcgccggggtcagcctgctgccggtgtgccagtccagctccatgcggaagaccgactggctccccatggcggtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacatcacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtcccctcccacctcgcccaccgcacccggaacgccctggacaacctggtgatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccaccaagcgggacctgggcatgtccaaggagccgggggtggtcagccccacgtcctacctggacgtggacctccaccccgccagcgcctggaccctgtacgccgtggcgaccaccgtcatcacgcccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccggctgtgcacccgcgaggagttcaccaagaaggtgcgcaccaacgccgccatgggcgcggtgttcacggaggagaaccagtgggactccgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctcatccggcagatggagggcgagggggtcctgagcaaggccgacctggagaacccccacctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10029 - RNA, 9873 nt, synthetic construct
  misc_feature 1..9873: note = derived and/or modified CDS sequence (opt1) from DENV-3__HM756279__SS-prME
  source 1..9873: mol_type = other RNA
accagcctctgcctcatgatgatcctgcccgccgccctggcgttccacctcaccagccgggacggggagccgcggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacaccgtcatcggcatcggggacaacgccctgaagatcaactggtacaagaagggctccagcatcgggaagatgttcgaggcgacggcccggggcgcccgccggatggccatcctgggcgacaccgcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggccgacatggggtgcgtcatcaactggaagggcaaggagctgaagtgcggcagcgggatcttcgtgaccaacgaggtgcacacctggacggagcagtacaagttccaggcggactcccccaagcgcctcgccaccgccatcgccggcgcctgggagaacggggtctgcggcatccgcagcaccacccggatggagaacctgctgtggaagcagatcgcgaacgagctcaactacatcctgtgggagaacaacatcaagctgacggtggtggtcggggacatcatcggcgtgctcgagcagggcaagcgcaccctgacgccccagccgatggagctgaagtactcctggaagacctgggggaaggccaagatcgtgacggccgagacccagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacgcagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacgtggcgcgacatggcgcacaccctgatcatgatcggcagcaacgcctccgaccggatggggatgggcgtgacctacctcgccctgatcgccaccttcaagatccagcccttcctggccctcgggttcttcctgcgcaagctgacgagccgggagaacctcctgctgggcgtgggcctcgcgatggccaccaccctgcagctgcccgaggacatcgagcagatggccaacgggatcgccctcggcctgatggcgctgaagctcatcacccagttcgagacgtaccagctgtggaccgccctgatcagcctgacctgctccaacaccatcttcacgctgaccgtcgcctggcgcaccgccaccctgatcctcgccggggtgagcctgctgccggtctgccagtccagctccatgcggaagacggactggctccccatggcggtggccgccatgggcgtgccgcccctcccgctgttcatcttcgggctcaaggacaccctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgacggtcgagaaggccgcggacatcacctgggaggaggaggccgagcagaccggggtgtcccacaacctgatgatcaccgtggacgacgacggcaccatgcgcatcaaggacgacgagacggagaacatcctcaccgtcctgctgaagaccgccctcctgatcgtgagcggcatcttcccgtactccatccccgccaccctgctcgtgtggcacacgtggcagaagcagacccagcggagcggggtcctgtgggacgtgcccagcccgcccgagacccagaaggccgagctggaggagggcgtgtaccgcatcaagcagcaggggaacttctgggagacccaggtcggcgtgggggtgcagaaggagggcgtcttccacacgatgtggcacgtgacccggggcgcggtgctcacctacaacgggaagcgcctggagcccaactgggccagcgtcaagaaggacctgatctcctacggcgggggctggcggctcagcgcccagtggcagaagggggaggaggtccaggtgatcgccgtcgagcccggcaagaaccccaagaacttccagaccatgcccggcacgttccagaccaccaccggggagatcggcgcgatcgccctggacttcaagcccgggacgtccggcagccccatcatcaaccgcgagggcaaggtggtggggctgtacggcaacggggtcgtgaccaagaacggcgggtacgtgagcggcatcgcccagaccaacgccgagccggacggccccacccccgagctggaggaggagatgttcaagaagcggaacctcacgatcatggacctgcaccccgggtccggcaagacccgcaagtacctgccggccatcgtccgggaggcgatcaagcgccggctccgcaccctgatcctggcccccacccgggtggtggccgccgagatggaggaggccctcaaggggctgcccatccgctaccagacgaccgcgaccaagagcgagcacaccggccgggagatcgtcgacctgatgtgccacgccacgttcaccatgcgcctcctgtcccccgtgcgggtgccgaactacaacctgatcatcatggacgaggcccacttcaccgaccccgccagcatcgccgcgcgcgggtacatctccacccgggtcggcatgggcgaggccgccgccatcttcatgacggcgacgccgcccgggaccgccgacgccttcccgcagagcaacgcccccatccaggacgaggagcgcgacatccccgagcgctcctggaacagcggcaacgagtggatcaccgacttcgccgggaagacggtgtggttcgtgccctccatcaaggcgggcaacgacatcgccaactgcctccggaagaacgggaagaaggtcatccagctgagccgcaagaccttcgacaccgagtaccagaagaccaagctgaacgactgggacttcgtggtgacgaccgacatctccgagatgggcgccaacttcaaggccgaccgggtcatcgacccgcgccggtgcctcaagcccgtgatcctgaccgacggccccgagcgcgtgatcctggccgggcccatgccggtcaccgcggccagcgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagagccggaagaccttcgtggagctgatgcgccgcggggacctcaccgtctggctggcgcacaaggtggcctccgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctacagcgaccccctggccctcaaggagttcaaggagttcgccgcgggccgcaagtccatcgccctggacctggtgaccgagatcgggcgggtgccgagccacctcgcccaccgcacgcggaacgccctggacaacctggtcatgctccacacctccgagcacggcgggcgcgcctaccggcacgcggtggaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatccccctgcagtggatcgcctccgcgatcgtcctggagttcttcatgatggtgctcctgatcccggagcccgagaagcagcgcacgccccaggacaaccagctggcctacgtggtcatcgggatcctcaccctggccgccatcatcgccgcgaacgagatgggcctgctcgagacgaccaagcgggacctgggcatgagcaaggagcccggggtggtgtccccgaccagctacctggacgtcgacctccaccccgcctccgcctggaccctgtacgccgtggcgacgaccgtgatcacccccatgctgcgccacaccatcgagaacagcacggccaacgtctccctcgccgccatcgccaaccaggcggtggtgctgatgggcctggacaaggggtggcccatcagcaagatggacctcggcgtcccgctgctggccctcgggtgctactcccaggtgaaccccctgaccctgaccgccgccgtgctcctgctgatcacccactacgccatcatcggccccggcctccaggcgaaggccacgcgggaggcccagaagcgcaccgccgccgggatcatgaagaaccccaccgtcgacggcatcatgaccatcgacctggacccggtgatctacgacagcaagttcgagaagcagctgggccaggtgatgctcctggtcctgtgcgcggtgcagctcctgctgatgcggacgtcctgggccctctgcgaggccctgaccctggccaccggccccatcaccacgctctgggagggcagccccgggaagttctggaacaccaccatcgcggtgtccatggccaacatcttccgcggcagctacctggccggggccggcctggccttctccatcatgaagtccgtcgggaccggcaagcggggcaccgggtcccagggcgagacgctcggggagaagtggaagaagaagctgaaccagctgagccgcaaggacttcgacctctacaagaagtccggcatcaccgaggtggaccggaccgaggcgaaggaggggctgaagcgcggcgagatcacccaccacgccgtgtcccggggcagcgccaagctgcagtggttcgtcgagcgcaacatggtgatccccgaggggcgggtgatcgacctcggctgcgggcgcggcgggtggtcctactactgcgccggcctgaagaaggtcacggaggtgcggggctacaccaagggcgggccggggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccacggtggaggagtcccgcaccatccgcgtcctgaagatggtggagccctggctcaagaacaaccagttctgcatcaaggtgctgaacccctacatgcccaccgtcatcgagcacctggagcggctccagcgcaagcacggcgggatgctggtgcggaaccccctgagccgcaactccacccacgagatgtactggatcagcaacggcacggggaacatcgtggcctccgtcaacatggtgagccggctcctgctgaaccgcttcaccatgacccaccggcgccccaccatcgagaaggacgtggacctcggcgcgggcacgcggcacgtcaacgccgagccggagacccccaacatggacgtgatcggggagcgcatcaagcggatcaaggaggagcacaactccacctggcactacgacgacgagaacccctacaagacctgggcctaccacggcagctacgaggtgaaggccacggggtccgccagctccatgatcaacggcgtcgtgaagctgctgaccaagccgtgggacgtcgtgcccatggtgacccagatggcgatgaccgacacgacccccttcgggcagcagcgcgtcttcaaggagaaggtggacacccggacgccccggagcatgccgggcacgcggcgcgtgatgggcatcaccgccgagtggctctggcggaccctggggcgcaacaagaagccccggctgtgcacccgcgaggagttcacgaagaaggtccgcaccaacgccgccatgggcgcggtgttcaccgaggagaaccagtgggacagcgccaaggccgccgtggaggacgaggacttctggaagctcgtcgaccgggagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacaccgcggggtgggacacgcgcatcaccgaggacgacctgcacaacgaggagaagatcacccagcagatggaccccgagcaccggcagctcgccaacgccatcttcaagctgacctaccagaacaaggtcgtgaaggtgcagcgcccgacccccacgggcaccgtcatggacatcatctcccggaaggaccagcgcggcagcggccaggtgggcacctacgggctgaacaccttcacgaacatggaggcccagctcatccggcagatggagggcgagggggtgctgtccaaggccgacctggagaacccccacctccccgagaagaagatcacccagtggctggagaccaagggcgtcgagcgcctgaagcggatggcgatcagcggcgacgactgcgtggtgaagccgatcgacgaccgcttcgccaacgccctcctggccctgaacgacatggggaaggtccggaaggacatcccccagtggcagccctccaagggctggcacgactggcagcaggtccccttctgcagccaccacttccacgagctcatcatgaaggacgggcgcaagctggtggtcccgtgccggccccaggacgagctgatcggccgcgcccggatctcccagggggcgggctggagcctcaaggagaccgcctgcctgggcaaggcctacgcccagatgtggtccctgatgtacttccaccgccgcgacctccggctggcgagcaacgccatctgctccgccgtgcccgtgcactgggtccccacgagccgcaccacctggtccatccacgcccaccaccagtggatgaccacggaggacatgctgaccgtgtggaaccgggtgtggatcgaggacaacccgtggatggaggacaagacccccgtcaccacgtgggagaacgtgccctacctcgggaagcgcgaggaccagtggtgcggcagcctgatcgggctgaccagccgggccacctgggcgcagaacatccccaccgccatccagcaggtccgctccctcatcggcaacgaggagttcctggactacatgccgagcatgaagcggttccgcaaggaggaggagtccgagggggccatctggtga

SEQ ID NO: 10030 - RNA, 9873 nt, synthetic construct
  misc_feature 1..9873: note = derived and/or modified CDS sequence (opt1) from DENV-3__HQ891025__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcaccatgacgcaccggcgcccgaccatcgagaaggacgtggacctcggcgcggggacccggcacgtcaacgccgagcccgagacccccaacatggacgtgatcggcgagcgcatcaagcggatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggcgatgaccgacaccacccccttcggccagcagcgcgtcttcaaggagaaggtggacacgcggaccccgcgcagcatgcccggcacccggcgcgtgatggggatcaccgccgagtggctctggcggacgctgggccgcaacaagaagccccggctgtgcacccgcgaggagttcaccaagaaggtccgcaccaacgccgccatgggggcggtgttcacggaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatctcccggaaggaccagcgcgggagcggccaggtggggacgtacggcctgaacaccttcaccaacatggaggcccagctcatccggcagatggagggggagggcgtgctgtccaaggccgacctggagaacccccacctcccggagaagaagatcacccagtggctggagacgaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagaccgcctgcctggggaaggcctacgcccagatgtggtccctgatgaacttccaccgccgcgacctccggctggcgagcaacgccatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgaccagccgggccacgtgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10031 - RNA, 9873 nt, synthetic construct
  misc_feature 1..9873: note = derived and/or modified CDS sequence (opt1) from DENV-3__HQ705617__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttccgcatccagcccttcctggccctcgggttcttcctgcggaagctgaccagccgcgagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcggaccgccaccctgatcctcgccggggtgagcctgctgccggtctgccagtccagctccatgcgcaagaccgactggctccccatggcggtggccgccatgggcgtgccgcccctcccgctgttcatcttcgggctcaaggacacgctgaagcgccggagctggcccctgaacgagggcgtcatggccgtgggcctcgtgtccatcctggccagctccctgctccgcaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcggatcaaggacgacgagaccgagaacatcctcacggtcctgctgaagaccgccctcctgatcgtgagcggcatcttcccgtactccatccccgccaccctgctcgtgtggcacacctggcagaagcagacgcagcgcagcggggtcctgtgggacgtgcccagcccgcccgagacccagaaggccgagctggaggagggcgtgtaccggatcaagcagcaggggatcttcggcaagacccaggtcggggtgggcgtgcagaaggagggcgtcttccacaccatgtggcacgtgacgcgcggggcggtgctcacctacaacggcaagcggctggagcccaactgggccagcgtcaagaaggacctgatctcctacgggggcgggtggcgcctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgggaggggaaggtggtgggcctgtacgggaacggcgtcgtgacgaagaacgggggctacgtgagcggcatcgcccagaccaacgccgagccggacgggcccacccccgagctggaggaggagatgttcaagaagcgcaacctcaccatcatggacctgcaccccggctccgggaagacgcggaagtacctgccggccatcgtccgcgaggcgatcaagcggcgcctccggaccctgatcctggcccccacccgcgtggtggccgccgagatggaggaggccctcaagggcctgcccatccggtaccagaccacggcgaccaagagcgagcacaccgggcgcgagatcgtcgacctgatgtgccacgccaccttcacgatgcggctcctgtcccccgtgcgcgtgccgaactacaacctgatcatcatggacgaggcccacttcaccgaccccgccagcatcgccgcgcggggctacatctccacccgcgtcggcatgggggaggccgccgccatcttcatgaccgcgacgccgcccggcaccgccgacgccttcccgcagagcaacgcccccatccaggacgaggagcgcgacatccccgagcggtcctggaacagcgggaacgagtggatcaccgacttcgccggcaagaccgtgtggttcgtgccctccatcaaggcggggaacgacatcgccaactgcctccgcaagaacggcaagaaggtcatccagctgagccggaagacgttcgacaccgagtaccagaagaccaagctgaacgactgggacttcgtggtgaccacggacatctccgagatgggcgccaacttcaaggccgaccgcgtcatcgacccgcggcgctgcctcaagcccgtgatcctgaccgacgggcccgagcgggtgatcctggccggccccatgccggtcaccgcggccagcgccgcccagcgccgggggcgcgtgggccggaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgcgagaagtccgccgccatcgacggcgagtaccggctgaagggggagagccgcaagaccttcgtggagctgatgcggcgcggcgacctccccgtctggctggcgcacaaggtggcctccgaggggatcaagtacaccgaccggaagtggtgcttcgacggccagcgcaacaaccagatcctggaggagaacatggacgtcgagatctggaccaaggagggcgagaagaagaagctccggccccgctggctggacgcccgcacgtacagcgacccgctggccctcaaggagttcaaggagttcgccgcggggcggaagtccatcgccctggacctggtgaccgagatcggccgcgtgcccagccacctcgcccaccggacccgcaacgccctggacaacctggtcatgctccacacctccgagcacgggggccgggcctaccgccacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcggacgccccaggacaaccagctggcctacgtggtcatcggcatcctcaccctggccgccatcatcgccgcgaacgagatgggcctgctcgagaccaccaagcgcgacctggggatgagcaaggagccgggcgtggtgtcccccacgagctacctggacgtcgacctccaccccgcctccgcctggaccctgtacgccgtggcgaccaccgtgatcacgcccatgctgcggcacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgcgaggcccagaagcggaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcgcacctcctgggccctctgcgaggccctgaccctggccacgggccccatcaccaccctctgggaggggagccccggcaagttctggaacaccacgatcgcggtgtccatggccaacatcttccgggggagctacctggccggcgccgggctggccttctccatcatgaagtccgtcggcaccggcaagcgcgggaccggctcccagggggagaccctcggcgagaagtggaagaagaagctgaaccagctgagccggaaggacttcgacctctacaagaagtccgggatcaccgaggtggaccgcacggaggcgaaggagggcctgaagcggggcgagatcacccaccacgccgtgtcccgcgggagcgccaagctgcagtggttcgtcgagcggaacatggtgatcccggagggccgcgtgatcgacctcgggtgcggccgcgggggctggtcctactactgcgccggcctgaagaaggtcaccgaggtgcgcgggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgggtcctgaagatggtggagccgtggctcaagaacaaccagttctgcatcaaggtgctgaacccctacatgcccacggtcatcgagcacctggagcgcctccagcggaagcacgggggcatgctggtgcgcaaccccctgagccggaactccacccacgagatgtactggatcagcaacgggaccggcaacatcgtggcctccgtcaacatggtgagccgcctcctgctgaaccggttcaccatgacgcaccgccggccgaccatcgagaaggacgtggacctcggcgcggggacccgccacgtcaacgccgagcccgagacccccaacatggacgtgatcggcgagcggatcaagcgcatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggcgatgaccgacaccacccccttcggccagcagcgggtcttcaaggagaaggtggacacgcgcaccccgcggagcatgcccggcacccgccgggtgatggggatcaccgccgagtggctctggcgcacgctgggccggaacaagaagccccgcctgtgcacccgcgaggagttcaccaagaaggtccggaccaacgccgccatgggggcggtgttcacggaggagaaccagtgggacagcgccaaggccgccgtggaggacgaggacttctggaagctcgtcgaccgcgagcgggagctgcacaagctgggcaagtgcgggtcctgcgtgtacaacatgatgggcaagcgcgagaagaagctcggcgagttcgggaaggccaagggcagccgggcgatctggtacatgtggctgggggcccgctacctggagttcgaggccctcggcttcctgaacgaggaccactggttctcccgggagaacagctactccggggtggagggcgagggcctgcacaagctcgggtacatcctgcgcgacatcagcaagatccccggcggggccatgtacgccgacgacaccgcgggctgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatctcccgcaaggaccagcgggggagcggccaggtggggacgtacggcctgaacaccttcaccaacatggaggcccagctcatccgccagatggagggggagggcgtgctgtccaaggccgacctggagaacccccacctcccggagaagaagatcacccagtggctggagacgaagggcgtcgagcggctgaagcgcatggcgatcagcggggacgactgcgtggtgaagcccatcgacgaccggttcgccaacgccctcctggccctgaacgacatgggcaaggtccgcaaggacatcccccagtggcagccctccaaggggtggcacgactggcagcaggtcccgttctgcagccaccacttccacgagctcatcatgaaggacggccggaagctggtggtcccctgccgcccccaggacgagctgatcgggcgggcccgcatctcccagggcgcgggctggagcctcaaggagaccgcctgcctggggaaggcctacgcccagatgtggtccctgatgtacttccaccgccgggacctccgcctggcgagcaacgccatctgctccgccgtgcccgtgcactgggtcccgaccagccggaccacgtggtccatccacgcccaccaccagtggatgaccaccgaggacatgctgaccgtgtggaaccgcgtgtggatcgaggacaacccctggatggaggacaagacgcccgtcaccacctgggagaacgtgccctacctcggcaagcgggaggaccagtggtgcgggagcctgatcggcctgaccagccgcgccacgtgggcgcagaacatcccgaccgccatccagcaggtccggtccctcatcgggaacgaggagttcctggactacatgcccagcatgaagcgcttccggaaggaggaggagtccgagggcgccatctggtga

SEQ ID NO: 10032 - RNA, 9873 nt, synthetic construct
  misc_feature 1..9873: note = derived and/or modified CDS sequence (opt1) from DENV-3__HQ705619__SS-prME
  source 1..9873: mol_type = other RNA
accagcctgtgcctgatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgcccgaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagaccctcacctggaaccgcaaggagctgctggtgaccttcaagaacgcccacgccaagaagcaggaggtggtcgtgctcgggtcccaggagggcgcgatgcacacggccctgaccggggccaccgagatccagaacagcggcgggacctccatcttcgccggccacctgaagtgccggctcaagatggacaagctggagctgaagggcatgagctacgccatgtgcacgaacaccttcgtgctcaagaaggaggtctccgagacccagcacgggaccatcctgatcaaggtggagtacaagggcgaggacgtgccctgcaagatcccgttcagcacggaggacgggcagggcaaggcgcacaacggccgcctgatcaccgccaaccccgtcgtgaccaagaaggaggagcccgtgaacatcgaggccgagcccccgttcggggagagcaacatcgtcatcggcatcggggacaacgccctgaagatcaactggtacaagaagggctccagcatcgggaagatgttcgaggcgaccgcccggggcgcccgccggatggccatcctcggcgacacggcctgggacttcgggtccgtgggcggggtgctgaacagcctgggcaagatggtccaccagatcttcgggtccgcgtacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggccgacatggggtgcgtcatcaactggaagggcaaggagctcaagtgcggcagcgggatcttcgtgaccaacgaggtgcacacctggaccgagcagtacaagttccaggcggactcccccaagcgcctggccacggccatcgccggcgcctgggagaacggggtctgcggcatccgcagcaccacccggatggagaacctgctctggaagcagatcgcgaacgagctgaactacatcctgtgggagaacaacatcaagctcaccgtggtggtcggggacatcatcggcgtgctggagcagggcaagcgcacgctgacgccccagcccatggagctcaagtactcctggaagacctgggggaaggccaagatcgtgaccgccgagacgcagaacagctccttcatcatcgacggcccgaacacccccgagtgccccagcgtctcccgggcctggaacgtgtgggaggtggaggactacgggttcggcgtcttcaccaccaacatctggctgaagctgcgcgaggtgtacacccagctctgcgaccaccggctgatgagcgcggccgtgaaggacgagcgcgccgtccacgccgacatgggctactggatcgagagccagaagaacgggtcctggaagctggagaaggccagcctcatcgaggtgaagacgtgcacctggcccaagtcccacaccctgtggagcaacggcgtgctggagtccgacatgatcatccccaagagcctcgcggggcccatctcccagcacaaccaccggcccggctaccacacccagacggccgggccgtggcacctgggcaagctggagctcgacttcaactactgcgagggcaccaccgtcgtgatcaccgagaactgcgggacgcgcggccccagcctgcggaccaccaccgtgtccgggaagctgatccacgagtggtgctgccgcagctgcacgctgccgcccctccggtacatgggcgaggacgggtgctggtacggcatggagatccgcccgatctccgagaaggaggagaacatggtcaagagcctggtgtccgccggcagcgggaaggtggacaacttcaccatgggcgtcctctgcctggccatcctgttcgaggaggtgatgcgggggaagttcggcaagaagcacatgatcgccggggtgttcttcaccttcgtcctcctgctgtccggccagatcacctggcgcgacatggcgcacacgctcatcatgatcggcagcaacgcctccgaccggatggggatgggcgtgacctacctggccctgatcgccaccttcaagatccagcccttcctcgccctggggttcttcctgcgcaagctcaccagccgggagaacctgctgctcggcgtgggcctggcgatggccacgaccctgcagctccccgaggacatcgagcagatggccaacgggatcgccctgggcctgatggcgctcaagctgatcacccagttcgagacctaccagctgtggacggccctcatcagcctgacctgctccaacaccatcttcaccctgacggtcgcctggcgcaccgccaccctcatcctggccggggtgagcctgctccccgtctgccagtccagctccatgcggaagaccgactggctgccgatggcggtggccgccatgggcgtgccgcccctgcccctcttcatcttcgggctgaaggacacgctgaagcgccgcagctggccgctcaacgagggcgtcatggccgtgggcctggtgtccatcctggccagctccctcctgcggaacgacgtccccatggcggggcccctggtggccggcgggctcctgatcgcctgctacgtgatcaccggcaccagcgccgacctgaccgtcgagaaggccgcggacatcacgtgggaggaggaggccgagcagaccggggtgtcccacaacctcatgatcaccgtggacgacgacggcaccatgcgcatcaaggacgacgagaccgagaacatcctgacggtcctgctcaagaccgccctgctgatcgtgagcggcatcttcccctactccatcccggccaccctcctggtgtggcacacctggcagaagcagacgcagcggagcggggtcctgtgggacgtgcccagcccgcccgagacccagaaggccgagctcgaggagggcgtgtaccgcatcaagcagcaggggatcttcggcaagacccaggtcggggtgggcgtgcagaaggagggcgtcttccacaccatgtggcacgtgacgcgcggggcggtgctgacctacaacggcaagcgcctggagccgaactgggccagcgtcaagaaggacctcatctcctacgggggcgggtggcggctgagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagccgggcacctccggcagccccatcatcaaccgcgaggggaaggtggtgggcctgtacgggaacggcgtcgtgacgaagaacgggggctacgtgagcggcatcgcccagaccaacgccgagcccgacgggccgacccccgagctcgaggaggagatgttcaagaagcggaacctgaccatcatggacctgcaccccggctccgggaagacgcgcaagtacctccccgccatcgtccgggaggcgatcaagcgccggctgcgcaccctgatcctcgccccgacccgggtggtggccgccgagatggaggaggccctgaagggcctgcccatccgctaccagaccacggcgaccaagagcgagcacaccgggcgggagatcgtcgacctcatgtgccacgccaccttcacgatgcgcctgctgtcccccgtgcgggtgcccaactacaacctcatcatcatggacgaggcccacttcaccgacccggccagcatcgccgcgcgcggctacatctccacccgggtcggcatgggggaggccgccgccatcttcatgaccgcgacgccgcccggcaccgccgacgccttcccccagagcaacgccccgatccaggacgaggagcgcgacatccccgagcgctcctggaacagcgggaacgagtggatcaccgacttcgccggcaagaccgtgtggttcgtgccctccatcaaggcggggaacgacatcgccaactgcctgcggaagaacggcaagaaggtcatccagctgagccgcaagacgttcgacaccgagtaccagaagaccaagctcaacgactgggacttcgtggtgaccacggacatctccgagatgggcgccaacttcaaggccgaccgggtcatcgacccccgccggtgcctgaagccggtgatcctgaccgacgggcccgagcgcgtgatcctcgccggccccatgcccgtcaccgcggccagcgccgcccagcggcgcgggcgggtgggccgcaacccgcagaaggagaacgaccagtacatcttcaccgggcagcccctgaacaacgacgaggaccacgcccactggaccgaggcgaagatgctgctcgacaacatcaacacgcccgagggcatcatccccgccctgttcgagccggagcgggagaagtccgccgccatcgacggcgagtaccgcctgaagggggagagccggaagaccttcgtggagctcatgcgccggggcgacctgcccgtctggctggcgcacaaggtggcctccgaggggatcaagtacaccgaccgcaagtggtgcttcgacggccagcggaacaaccagatcctcgaggagaacatggacgtcgagatctggaccaaggagggcgagaagaagaagctgcgcccccggtggctggacgcccgcacgtacagcgaccccctcgccctgaaggagttcaaggagttcgccgcggggcgcaagtccatcgccctggacctcgtgaccgagatcggccgggtgccgagccacctggcccaccgcacccggaacgccctggacaacctcgtcatgctgcacacctccgagcacgggggccgcgcctaccggcacgcggtggaggagctgcccgagacgatggagaccctcctgctgctcgggctgatgatcctgctcaccggcggcgccatgctgttcctgatcagcgggaagggcatcgggaagaccagcatcggcctcatctgcgtgatcgcctccagcgggatgctgtggatggccgagatccccctgcagtggatcgcctccgcgatcgtcctcgagttcttcatgatggtgctgctgatcccggagcccgagaagcagcgcacgccccaggacaaccagctcgcctacgtggtcatcggcatcctgaccctggccgccatcatcgccgcgaacgagatgggcctcctggagaccaccaagcgggacctggggatgagcaaggagcccggcgtggtgtccccgacgagctacctcgacgtcgacctgcaccccgcctccgcctggaccctgtacgccgtggcgaccaccgtgatcacgcccatgctccgccacaccatcgagaacagcaccgccaacgtctccctggccgccatcgccaaccaggcggtggtgctgatggggctcgacaagggctggcccatcagcaagatggacctgggggtcccgctgctcgccctgggctgctactcccaggtgaaccccctgaccctcacggccgccgtgctgctgctcatcacccactacgccatcatcggccccgggctgcaggcgaaggccacccgggaggcccagaagcgcaccgccgccggcatcatgaagaaccccacggtcgacgggatcatgaccatcgacctggacccggtgatctacgacagcaagttcgagaagcagctcggccaggtgatgctgctggtcctctgcgcggtgcagctgctgctcatgcggacctcctgggccctgtgcgaggccctgaccctcgccacgggccccatcaccaccctgtgggaggggagccccggcaagttctggaacaccacgatcgcggtgtccatggccaacatcttccgcgggagctacctggccggcgccgggctcgccttctccatcatgaagtccgtcggcaccggcaagcgggggaccggctcccagggggagaccctgggcgagaagtggaagaagaagctgaaccagctcagccgcaaggacttcgacctgtacaagaagtccgggatcaccgaggtggaccggacggaggcgaaggagggcctgaagcgcggcgagatcacccaccacgccgtgtcccgggggagcgccaagctccagtggttcgtcgagcgcaacatggtgatccccgagggccgggtgatcgacctggggtgcggccgcgggggctggtcctactactgcgccggcctgaagaaggtcaccgaggtgcgggggtacaccaagggcgggccgggccacgaggagcccgtgcccatgagcacgtacgggtggaacatcgtcaagctcatgtccggcaaggacgtgttctacctgcccccggagaagtgcgacaccctgctgtgcgacatcggcgagagctcccccagccccaccgtggaggagtcccgcaccatccgcgtcctcaagatggtggagccctggctgaagaacaaccagttctgcatcaaggtgctgaacccgtacatgcccacggtcatcgagcacctcgagcggctgcagcgcaagcacgggggcatgctggtgcggaaccccctcagccgcaactccacccacgagatgtactggatcagcaacgggaccggcaacatcgtggcctccgtcaacatggtgagccggctgctgctcaaccgcttcaccatgacgcaccggcgccccaccatcgagaaggacgtggacctgggcgcggggacccggcacgtcaacgccgagccggagacccccaacatggacgtgatcggcgagcgcatcaagcggatcaaggaggagcacaactccacgtggcactacgacgacgagaacccctacaagacctgggcctaccacgggagctacgaggtgaaggccaccggctccgccagctccatgatcaacggggtcgtgaagctgctcaccaagccgtgggacgtcgtgcccatggtgacgcagatggcgatgaccgacaccacccccttcggccagcagcgcgtcttcaaggagaaggtggacacgcggacgccccgcagcatgccgggcacccggcgcgtgatggggatcaccgccgagtggctgtggcggaccctgggccgcaacaagaagccccggctctgcacccgcgaggagttcaccaagaaggtccgcaccaacgccgccatgggggcggtgttcacggaggagaaccagtgggacagcgccaaggccgccgtggaggacgaggacttctggaagctggtcgaccgggagcgcgagctgcacaagctcggcaagtgcgggtcctgcgtgtacaacatgatgggcaagcgggagaagaagctgggcgagttcgggaaggccaagggcagccgcgcgatctggtacatgtggctgggggcccggtacctcgagttcgaggccctgggcttcctgaacgaggaccactggttctcccgcgagaacagctactccggggtggagggcgagggcctccacaagctggggtacatcctgcgggacatcagcaagatccccggcggggccatgtacgccgacgacaccgcgggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgcccgacccccaccggcaccgtcatggacatcatctcccggaaggaccagcgcgggagcggccaggtggggacgtacggcctcaacaccttcaccaacatggaggcccagctgatccggcagatggagggggagggcgtgctgtccaaggccgacctcgagaacccccacctccccgagaagaagatcacccagtggctggagacgaagggcgtcgagcgcctcaagcggatggcgatcagcggggacgactgcgtggtgaagccgatcgacgaccgcttcgccaacgccctgctggccctcaacgacatgggcaaggtccggaaggacatcccccagtggcagccctccaaggggtggcacgactggcagcaggtccccttctgcagccaccacttccacgagctgatcatgaaggacggccgcaagctggtggtcccgtgccggccccaggacgagctcatcgggcgcgcccggatctcccagggcgcgggctggagcctgaaggagaccgcctgcctggggaaggcctacgcccagatgtggtccctcatgtacttccaccgccgcgacctgcggctggcgagcaacgccatctgctccgccgtgcccgtgcactgggtccccaccagccgcaccacgtggtccatccacgcccaccaccagtggatgaccaccgaggacatgctcaccgtgtggaaccgggtgtggatcgaggacaacccgtggatggaggacaagacgcccgtcaccacctgggagaacgtgccctacctgggcaagcgcgaggaccagtggtgcgggagcctgatcggcctcaccagccgggccacgtgggcgcagaacatccccaccgccatccagcaggtccgctccctgatcgggaacgaggagttcctggactacatgccgagcatgaagcggttccgcaaggaggaggagtccgagggcgccatctggtga

SEQ ID NO: 10033 - RNA, 9873 nt, synthetic construct
  misc_feature 1..9873: note = derived and/or modified CDS sequence (opt1) from DENV-3__HQ705620__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctgggtgggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgccggctgaccagccgcgagaacctcctgctgggcgtcggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtggcctggcggaccgccaccctgatcctcgccggggtcagcctgctgccggtgtgccagtccagctccatgcgcaagaccgactggctccccatggcggtggccgccatgggcgtgccgcccctcccgctgttcatcttcagcctcaaggacacgctgaagcgccggtcctggcccctgaacgagggggtgatggccgtgggcctcgtcagcatcctggcctccagcctgctccgcaacgacgtgcccatggcgggccccctggtggccgggggcctgctcatcgcctgctacgtcatcaccgggacctccgccgacctgaccgtggagaaggccgcggacatcacgtgggaggaggaggccgagcagaccggcgtgagccacaacctgatgatcaccgtcgacgacgacgggaccatgcggatcaaggacgacgagaccgagaacatcctcacggtgctgctgaagaccgccctcctgatcgtgtccggcatcttcccgtacagcatccccgccaccctgctcgtctggcacacctggcagaagcagacgcagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacgcgcggcgcggtcctcacctacaacgggaagcggctggagcccaactgggcctccgtgaagaaggacctgatcagctacggcgggggctggcgcctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgggagggcaaggtggtcgggctgtacggcaacggggtggtgacgaagaacggcgggtacgtctccggcatcgcccagaccaacgccgagccggacggccccacccccgagctggaggaggagatgttcaagaagcgcaacctcaccatcatggacctgcaccccgggagcggcaagacgcggaagtacctgccggccatcgtgcgcgaggcgatcaagcggcgcctccggaccctgatcctggcccccacccgcgtggtcgccgccgagatggaggaggccctcaaggggctgcccatccggtaccagaccacggcgaccaagtccgagcacaccggccgcgagatcgtggacctgatgtgccacgccaccttcacgatgcggctcctgagccccgtgcgcgtcccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtgtggttcgtccccagcatcaaggcgggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggagttcgccgcgggccgcaagagcatcgccctggacctggtgaccgagatcgggcgcgtcccctcccacctcgcccaccggacccgcaacgccctggacaacctggtgatgctccacaccagcgagcacggcgggcgggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagcggaagctgaaccagctgagccgcaaggacttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctcatccggcagatggagggcgagggggtcctgagcaaggccgacctggagaacccccacctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccgcatcagccagggggcgggctggtccctcaaggagaccgcctgcctgggcaaggcctacgcccagatgtggagcctgatgtacttccaccggcgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10034 - RNA, 9873 nt, synthetic construct
  misc_feature 1..9873: note = derived and/or modified CDS sequence (opt1) from DENV-3__HQ705621__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcgcacggccaccctgatcctcgccggggtgagcctgctgccgatgtgccagtccagctccatgcggaagaccgactggctccccatggcggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtgcgggaggcgatcaagcgccggctccgcacgctgatcctggcccccacccgggtcgtggccgccgagatggaggaggccctcaaggggctgcccatccgctaccagaccaccgcgacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgccgcgcgcgggtacatcagcacccgggtgggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggagttcgccgcgggccgcaagagcatcgccctggacctggtcacggagatcgggcgggtgccctcccacctcgcccaccgcacccggaacgccctggacaacctggtgatgctccacaccagcgagcacggcgggcgcgcctaccggcacgcggtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcgcacgccccaggacaaccagctggcctacgtggtgatcgggatcctcacgctggccgccatcatcgccgcgaacgagatgggcctgctcgagaccaccaagcgggacctgggcatgtccaaggagccgggggtcgtgagccccacctcctacctggacgtggacctccaccccgccagcgcctggacgctgtacgccgtcgcgaccaccgtgatcacccccatgctgcgccacacgatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgccatcatcggccccggcctccaggcgaaggccacccgggaggcccagaagcgcaccgccgccgggatcatgaagaacccgaccgtggacggcatcatgacgatcgacctggaccccgtcatctacgactccaagttcgagaagcagctgggccaggtgatgctcctggtgctgtgcgtcgtgcagctcctgctgatgcggaccagctgggcgctctgcgaggccctgaccctggccaccggccccatcacgaccctctgggagggctcccccgggaagttctggaacaccaccatcgccgtgagcatggcgaacatcttccgcggctcctacctggccggggccggcctggccttcagcatcatgaagtccgtcgggacgggcaagcggggcaccgggagccagggcgagaccctcggggagaagtggaagaagaagctgaaccagctgagccgcaaggacttcgacctctacaagaagtccggcatcaccgaggtggaccggaccgaggccaaggaggggctgaagcgcggcgagatcacgcaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgcggagcccgagacccccaacatggacgtgatcggggagcgcatcaagcggatcaaggaggagcacaacagcacctggcaccacgacgacgagaacccgtacaagacgtgggcctaccacggctcctacgaggtgaaggccaccgggagcgcctccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgcggagtggctctggcggaccctggggcgcaacaagaagccccggctgtgcacgcgcgaggagttcaccaagaaggtccgcaccaacgccgccatgggcgccgtgttcaccgaggagaaccagtgggactccgcgaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacacggccgggtgggacacccgcatcaccgaggacgacctgcacaacgaggagaagatcacccagcagatggacccggagcaccggcagctcgcgaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgcgaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctcaaggagacggcgtgcctgggcaaggcctacgcccagatgtggagcctgatgtacttccaccgccgcgacctccggctggcctccaacgcgatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggccacctgggcccagaacatcccgacggcgatccagcaggtccgcagcctcatcggcaacgaggagttcctggactacatgccctccatgaagcggttccgcaaggaggaggagagcgagggggccatctggtga

SEQ ID NO: 10035 - RNA, 9873 nt, synthetic construct
  misc_feature 1..9873: note = derived and/or modified CDS sequence (opt1) from DENV-3__HQ671176__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcgcacggccaccctgatcctcgccggggtgagcctgctgccgatgtgccagtccagctccatgcggaagaccgactggctccccatggcggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtgcgggaggcgatcaagcgccggctccgcacgctgatcctggcccccacccgggtcgtggccgccgagatggaggaggccctcaaggggctgcccatccgctaccagaccaccgcgacgaagtccgagcacaccggccgggagatcgtggacctgatgtgccacgccaccttcaccatgcgcctcctgagccccgtccgggtgccgaactacaacctgatcgtgatggacgaggcccacttcacggaccccgcctccatcgccgcgcgcgggtacatcagcacccgggtcggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggagttcgccgcgggccgcaagagcatcgccctggacctggtgacggagatcgggcgggtgccctcccacctcgcccaccgcacccggaacgccctggacaacctggtcatgctccacaccagcgagcacggcgggcgcgcctaccggcacgcggtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcacgctggccgccatcatcgccgcgaacgagatgggcctgctcgagaccaccaagcgggacctgggcatgtccaaggagccgggggtggtgagccccacctcctacctggacgtcgacctccaccccgccagcgcctggacgctgtacgccgtggcgaccaccgtgatcacccccatgctgcgccacacgatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgaccgccgccgtgctcctgctgatcacgcactacgccatcatcggccccggcctccaggcgaaggccacccgggaggcccagaagcgcaccgccgccgggatcatgaagaacccgaccgtcgacggcatcatgacgatcgacctggaccccgtgatctacgactccaagttcgagaagcagctgggccaggtgatgctcctggtcctgtgcgcggtgcagctcctgctgatgcggaccagctgggccctctgcgaggccctgaccctggccaccggccccatcacgaccctctgggagggctcccccgggaagttctggaacaccaccatcgcggtgagcatggccaacatcttccgcggctcctacctggccggggccggcctggccttcagcatcatgaagtccgtcgggacgggcaagcggggcaccgggagccagggcgagaccctcggggagaagtggaagaagaagctgaaccagctgagccgcaaggacttcgacctctacaagaagtccggcatcaccgaggtggaccggaccgaggcgaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgcgggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtcgtgcccatggtgacccagatggcgatgacggacaccacccccttcgggcagcagcgcgtcttcaaggagaaggtggacacccggacgccgcgcagcatgcccggcacccggcgcgtgatgggcatcaccgccgagtggctctggcggaccctggggcgcaacaagaagccccggctgtgcacgcgcgaggagttcaccaagaaggtccgcaccaacgccgccatgggcgcggtgttcaccgaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacacggcggggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggccgacctggagaacccccacctcccggagaagaagatcacccagtggctggagaccaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagacggcctgcctgggcaaggcctacgcccagatgtggagcctgatgtacttccaccgccgcgacctccggctggcgtccaacgccatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggccacctgggcgcagaacatcccgacggccatccagcaggtccgcagcctcatcggcaacgaggagttcctggactacatgccctccatgaagcggttccgcaaggaggaggagagcgagggggccatctggtga
